United States Patent
Esau et al.

(10) Patent No.: US 11,912,997 B2
(45) Date of Patent: Feb. 27, 2024

(54) RNAI AGENTS FOR INHIBITING EXPRESSION OF SUPEROXIDE DISMUTASE 1 (SOD1), COMPOSITIONS THEREOF, AND METHODS OF USE

(71) Applicant: Arrowhead Pharmaceuticals, Inc., Pasadena, CA (US)

(72) Inventors: Christine Esau, San Diego, CA (US); Ji Young Suk, San Diego, CA (US); Tao Pei, Middleton, WI (US); Anthony Nicholas, Oregon, WI (US); Xiaokai Li, Middleton, WI (US); Jeffrey Carlson, Madison, WI (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 0 days.

(21) Appl. No.: 18/334,932

(22) Filed: Jun. 14, 2023

(65) Prior Publication Data
US 2024/0026363 A1  Jan. 25, 2024

Related U.S. Application Data

(60) Provisional application No. 63/495,517, filed on Apr. 11, 2023, provisional application No. 63/352,454, filed on Jun. 15, 2022.

(51) Int. Cl.
*C12N 15/113* (2010.01)
*A61P 35/00* (2006.01)
*A61P 25/28* (2006.01)

(52) U.S. Cl.
CPC .......... *C12N 15/1137* (2013.01); *A61P 25/28* (2018.01); *C12N 2310/11* (2013.01); *C12N 2310/32* (2013.01); *C12N 2310/3515* (2013.01)

(58) Field of Classification Search
CPC ............ C12N 15/1137; C12N 2310/11; C12N 2310/3515; A61P 25/28
See application file for complete search history.

(56) References Cited

U.S. PATENT DOCUMENTS

| | | |
|---|---|---|
| 4,522,811 A | 6/1985 | Eppstein et al. |
| 5,998,203 A | 12/1999 | Matulic-Adamic et al. |
| 8,008,271 B2 | 8/2011 | Xu et al. |
| 8,981,074 B2 | 3/2015 | Kubo et al. |
| 10,131,904 B2 | 11/2018 | Pavco et al. |
| 10,385,341 B2 | 8/2019 | Swayze |
| 10,597,660 B2 | 3/2020 | Sah et al. |
| 10,669,546 B2 | 6/2020 | Swayze |
| 10,920,227 B2 | 2/2021 | Sah et al. |
| 2006/0229268 A1 | 10/2006 | Benjamin et al. |
| 2008/0113375 A1 | 5/2008 | Khvorova et al. |

FOREIGN PATENT DOCUMENTS

| | | | |
|---|---|---|---|
| WO | 2000053722 A2 | 9/2000 | |
| WO | 200606203 A2 | 6/2006 | |
| WO | 2008022309 A2 | 2/2008 | |
| WO | WO-2009102427 A2 * | 8/2009 | ............... A61P 1/04 |
| WO | 2011104169 A1 | 9/2011 | |
| WO | 2012083185 A2 | 6/2012 | |
| WO | 2023280190 A1 | 12/2012 | |
| WO | 2013032829 A1 | 3/2013 | |
| WO | 2013158141 A1 | 10/2013 | |
| WO | 2015153800 A2 | 10/2015 | |
| WO | WO-2015153800 A2 * | 10/2015 | ........... A61K 31/711 |
| WO | 2016077689 A1 | 5/2016 | |
| WO | 2017214112 A1 | 12/2017 | |
| WO | 2018002762 A1 | 1/2018 | |
| WO | 2019161213 A1 | 8/2019 | |
| WO | 2019217459 A1 | 11/2019 | |
| WO | 2020257194 A1 | 12/2020 | |
| WO | 2021030778 A1 | 2/2021 | |
| WO | 2021142313 A1 | 7/2021 | |
| WO | 2022174000 A2 | 8/2022 | |

OTHER PUBLICATIONS

GenBank NM_000454.5; *Homo sapiens* superoxide dismutase 1 (SOD1), mRNA; 2023.
Spinraza Prescribing Information; Biogen; https://www.accessdata.fda.gov/drugsatfda_docs/label/2020/209531s010lbl.pdf; Reference ID: 4625921; 2020.
Alnylam Pharmaceuticals; "Progress in Extrahepatic Silencing with siRNA Conjugates"; Presentation; Mar. 29, 2019.
Altenhofer, et al.; "Synthesis of a novel cyclopropyl phosphonate nucleotide as a phosphate mimic"; Chemical communications (Cambridge, England), 57(55), 6808-6811. https://doi.org/10.1039/d1cc02328d; 2021.
Andersen, et al.; "Phenotypic heterogeneity in motor neuron disease patients with CuZn-superoxide dismutase mutations in Scandinavia"; Brain : a journal of neurology, 120 ( Pt 10), 1723-1737. https://doi.org/10.1093/brain/120.10.1723; 1997.
Andersen, et al.; "Phenotype in an Infant with SOD1 Homozygous Truncating Mutation"; The New England Journal of Medicine; 381; 5; 2019.
Berdynski, et al.; SOD1 mutations associated with amyotrophic lateral sclerosis analysis of variant severity; Scientific Reports; 12(1); 103; https://doi.org/10.1038/s41598-021-03891-8; 2022.

(Continued)

Primary Examiner — Terra C Gibbs
(74) Attorney, Agent, or Firm — Paul VanderVelde; Robert M. Teigen; Meibo Chen

(57) ABSTRACT

Described are RNAi agents, compositions that include RNAi agents, and methods for inhibition of a Superoxide Dismutase 1 (SOD1) gene. The SOD1 RNAi agents and RNAi agent conjugates disclosed herein inhibit the expression of an SOD1 gene. Pharmaceutical compositions that include one or more SOD1 RNAi agents, optionally with one or more additional therapeutics, are also described. Delivery of the described SOD1 RNAi agents to central nervous system (CNS) tissue, in vivo, provides for inhibition of SOD1 gene expression and a reduction in SOD1 activity, which can provide a therapeutic benefit to subjects, including human subjects, for the treatment of various diseases including amyotrophic lateral sclerosis (ALS.).

30 Claims, No Drawings

Specification includes a Sequence Listing.

(56) References Cited

OTHER PUBLICATIONS

Bergemalm, et al.; "Superoxide dismutase-1 and other proteins in inclusions from transgenic amyotrophic lateral sclerosis model mice"; Journal of Neurochemistry; 114; 408-418; 2010.
Borel, et al.; "Safe and effective superoxide dismutase 1 silencing using artificial microRNA in macaques"; Sci. Transl. Med.; 10; eaau6414; 2018.
Brown, et al.; "Estimated Prevalence and Incidence of Amyotrophic Lateral Sclerosis and SOD1 and C9orf72 Genetic Variants"; Neuroepidemiology; DOI: 10.1159/000516752; 2021. (Including Supplemental Material).
Bruijn, et al.; "Mechanisms of selective motor neuron death in ALS: insights from transgenic mouse models of motor neuron disease"; Neuropathology and applied neurobiology, 22(5), 373-387. https://doi.org/10.1111/j.1365-2990.1996.tb00907.x; 1996.
Butti, et al.; "Dysregulation in Amyotrophic Lateral Sclerosis"; Frontiers in Genetics; 9; 712; https://doi.org/10.3389/fgene.2018.00712; 2019.
Chio, et al.; "Global epidemiology of amyotrophic lateral sclerosis: a systematic review of the published literature"; Neuroepidemiology, 41(2), 118-130. https://doi.org/10.1159/000351153; 2013.
Cleveland, et al.; "Toxic mutants in Charcot's sclerosis"; Nature, 378(6555), 342-343. https://doi.org/10.1038/378342a0; 1995.
Crapo, et al.; "Copper, zinc superoxide dismutase is primarily a cystolic protein in human cells"; Proc. Natl. Acad. Sci. USA; 89(21):10405-10409; doi: 10.1073/pnas.89.21.10405; 1992.
Czauderna, et al.; "Structural variations and stabilising modifications of synthetic siRNAs in mammalian cells"; Nucleic acids research, 31(11), 2705-2716. https://doi.org/10.1093/nar/gkg393; 2003.
D'Souza, et al.; "CNS Delivery of Nucleic Acid Therapeutics: Beyond the Blood-Brain Barrier and Towards Specific Cellular Targeting"; Pharmaceutical Research; https://doi.org/10.1007//s11095-022-03433-5; 2022.
Goodnow, Robert A.; "Reality check: lipid-oligonucleotide conjugates for therapeutic applications"; Expert Opinion on Drug Discovery; DOI: 10.1080/17460441.2022.2157399; 2002.
Gurney, et al.; "Motor Neuron Degeneration in Mice That Express a Human Cu, Zn Superoxide Dismutase Mutation"; Science; vol. 264; 1772-1775; https://doi.org/10.1126/science.8209258; 1994.
Hardiman, et al.; "Amyotrophic lateral sclerosis"; Nature reviews. Disease primers, 3, 17071. https://doi.org/10.1038/nrdp.2017.71; 2017.
Hodgson, et al.; "The Neurotoxicity of Drugs Given Intrathecally (Spinal)"; Anesth. Analg.; 88:797-809; 1999.
Hummel, et al.; "Expression and cell type-specific localization of inflammasome sensors in the spinal cord of SOD1 (G93A) mice and sALS patients"; Neuroscience; doi: https://doi.org/10.1016/j.neuroscience.2021.03.023; 2021.
Julien, et al.; "Transgenic mouse models of amyotrophic lateral sclerosis"; Biochimica et Biophysica Acta 1762; 1013-1024; 2006.
Kamola, et al.; "The siRNA Non-seed Region and Its Target Sequences Are Auxiliary Determinants of Off-Target Effects"; PLoS computational biology, 11(12), e1004656. https://doi.org/10.1371/journal.pcbi.1004656; 2015.
Kepp, Kasper P.; "Genotype-Property Patient-Phenotype Relations Suggest that Proteome Exhaustion Can Cause Amyotrophic Lateral Sclerosis"; PLoS ONE; 10(3): e0118649; doi:10.1371/journal.pone.0118649; 2015.
Kubo, et al.; "Palmitic Acid-Conjugated 21-Nucleotide siRNA Enhances Gene-Silencing Activity"; dx.doi.org/10.1021/mp200250f; Mol. Pharmaceutics; 8; 2193-2203; 2011.
Lu, et al.; "Mutant Cu/Zn-superoxide dismutase associated with amyotrophic lateral sclerosis destabilizes vascular endothelial growth factor mRNA and downregulates its expression."; The Journal of neuroscience: the official journal of the Society for Neuroscience, 27(30), 7929-7938. https://doi.org/10.1523/JNeurosci.1877-07.2007; 2007.
Maier, et al.; "A human-derived antibody targets misfolded SOD1 and ameliorates motor symptoms in mouse models of amyotrophic lateral sclerosis"; Sci. Transl. Med.; 10; eaah3924; 2018.
Mann, et al.; "Techniques for Motor Assessment in Rodents"; Movement Disorders, Second Edition; pp. 139-1578; http://dx.doi.org/10.1016/B978-0-12-405195-9.00008-1; 2015.
McCampbell, et al.; "Antisense oligonucleotides extend survival and reverse decrement in muscle response in ALS models"; J. Clin. Invest.; 128(8):3558-3567; https://doi.org/10.1172/JCI99081; 2018. (Including Supplemental Material).
Miller, et al.; "Trial of Antisense Oligonucleotide Tofersen for SOD1 ALS"; The New England Journal of Medicine; 387; 12; 1099-1110; 2022.
Miller, et al.; "Results from the Phase 3 VALOR study and its open-label extension: evaluating the clinical efficacy and safety of tofersen in adults with ALS and confirmed SOD1 mutation"; American Neurological Association Annual Meeting; Oct. 17-19, 2021.
Miller, et al.; "Evaluating Efficacy and Safety of Tofersen in Adults with SOD1-ALS: Results from the Phase 3 VALOR Trial and Open-Label Extension"; European Network for the Cure of Amyotrophic Lateral Sclerosis; 20th Meeting; Jun. 1-3, 2022.
Miller, et al.; "A Phase I, Randomised, First-in-Human Study of an Antisense Oligonucleotide Directed Against SOD1 Delivered Intrathecally in SOC1-Familial ALS Patients"; Lancet Neurol.; 12(15): 435-442; doi:10.1016/S1474-4422(13)70061-9; 2013.
Miller, et al.; "Phase 1-2 Trial of Antisense Oligonucleotide Tofersen for SOD1 ALS"; New England Journal of Medicine; 383: 109-19; DOI: 10.1056/NEJMoa2003715; 2020. (Including Supplemental Material).
Mueller, et al.; "SOD1 Suppression with Adeno-Associated Virus and MicroRNA in Familial ALS"; New England Journal of Medicine; 383: 151-158; DOI: 10.1056/NEJMoa2005056; 2020.
Nowicka, et al.; "Risk Factors and Emerging Therapies in Amyotrophic Lateral Sclerosis"; International journal of molecular sciences, 20(11), 2616. https://doi.org/10.3390/ijms20112616; 2019.
Olubunmi, et al.; "ALSoD: A user-friendly online bioinformatics tool for amyotrophic lateral sclerosis genetics"; Human mutation, 33(9), 1345-1351. https://doi.org/10.1002/humu.22157; 2012.
Park, et al.; "SOD1 deficiency: a novel syndrome distinct from amyotrophic lateral sclerosis"; Brain; 142; 2230-2237; 2019.
Powell, et al.; "Targeted gene silencing in the nervous system with CRISPR-Cas13"; Sci. Adv.; 8; eabk2485; 2022.
Reaume, et al.; "Motor neurons in Cu/Zn superoxide dismutase-deficient mice develop normally but exhibit enhanced cell death after axonal injury"; Nature genetics, 13(1), 43-47. https://doi.org/10.1038/ng0596-43; 1996.
Reddi, et al.; "SOD1 integrates signals from oxygen and glucose to repress respiration"; Cell, 152(1-2), 224-235. https://doi.org/10.1016/j.cell.2012.11.046; 2013.
Rosen, et al.; "Mutations in Cu/Zn superoxide dismutase gene are associated with familial amyotrophic lateral sclerosis"; Nature, 362(6415), 59-62. https://doi.org/10.1038/362059a0; 1993.
Rothstein, J. D.; "TDP-43 in amyotrophic lateral sclerosis: pathophysiology or pathobabel?" Annals of Neurology; 61(5); 382-384; https://doi.org/10/1002/ana.21155; 2007.
Rotunno, et al.; "An emerging role for misfolded wild-type SOD1 in sporadic ALS pathogenesis"; Frontiers in Cellular Neuroscience; vol. 7; Article 253; doi: 10.3389/fncel.2013.00253; 2013.
Sakellariou, et al.; "Comparison of Whole Body SOD1 Knockout with Muscle-Specific SOD1 Knockout Mice Reveals a Role for Nerve Redox Signaling in Regulation of Degenerative Pathways in Skeletal Muscle"; Antioxidants & Redox Signaling; vol. 28, No. 4; DOI: 10.1089/ars.2017.7249; 2018.
Takashima, et al.; "A Metal-Free, Disulfide Oxidized Form of Superoxide Dismutase 1 as a Primary Misfolded Species with Prion-Like Properties in the Extracellular Environments Surrounding Motor Neuron-Like Cells"; Int. J. Mol. Sci.; 22; 4155; https://doi.org/10.3390/ijms22084155; 2021.
Tsang, et al.; "Superoxide dismutase 1 acts as a nuclear transcription factor to regulate oxidative stress resistance"; Nature Communications; 5; 3446; https://doi.org/10.1038/ncomms4446; 2014.
Van Der Spek, et al.; "The project MinE databrowser: bringing large-scale whole-genome sequencing in ALS to researchers and the

(56) References Cited

OTHER PUBLICATIONS public"; Amyotrophic lateral sclerosis & frontotemporal degeneration, 20(5-6), 432-440; https://doi.org/10.1080/21678421.2019.1606244; 2019.

Vucic, et al.; "ALS is a multistep process in South Korean, Japanese, and Australian patients"; Neurology; vol. 94; No. 15; 2020.

Wang, et al.; "Cryo-EM structure of an amyloid fibril formed by full-length human SOD1 reveals its confirmational conversion"; Nature Communications; 13:3491; https://doi.org/10.1038/s41467-022-31240-4; 2022.

Yamashita, et al.; "Genotype-phenotype relationship in hereditary amyotrophic lateral sclerosis"; Translational Neurodegeneration; DOI: 10.1186/s40035-015-0036-y; 4:13; 2015.

* cited by examiner

RNAI AGENTS FOR INHIBITING EXPRESSION OF SUPEROXIDE DISMUTASE 1 (SOD1), COMPOSITIONS THEREOF, AND METHODS OF USE

CROSS REFERENCE TO RELATED APPLICATIONS

This application claims the benefit of priority of U.S. Provisional Patent Application Ser. No. 63/495,517, filed on Apr. 11, 2023, and U.S. Provisional Patent Application Ser. No. 63/352,454, filed on Jun. 15, 2022, the contents of each of which are incorporated herein by reference in their entirety.

SEQUENCE LISTING

This application contains a Sequence Listing which has been submitted in XML format and is hereby incorporated by reference in its entirety. The XML copy is named 30699-WO_SEQLIST.xml, was created Jun. 13, 2023, and is 6499 kb in size.

FIELD OF THE INVENTION

The present disclosure relates to RNA interference (RNAi) agents, e.g., double stranded RNAi agents such as chemically modified small interfering RNAs (siRNAs), for inhibition of Superoxide Dismutase 1 ("SOD1") gene expression, compositions that include SOD1 RNAi agents, and methods of use thereof.

BACKGROUND

Superoxide dismutase 1 (SOD1) is a member of the class of superoxide dismutase family of free radical scavenging enzymes that guard against oxygen radical species produced during cellular metabolism. All mammals possess 3 isoforms of superoxide dismutase: Cu/ZnSOD (SOD1), the mitochondrial MnSOD (SOD2), and the extracellular Cu/ZnSOD (SOD3). SOD1 is the highly abundant, ubiquitously expressed, and predominant dismutase in the cytoplasm and contributes to the majority of cellular SOD activity (JD Crapo et al., Copper, zinc superoxide dismutase is primarily a cytosolic protein in human cells. Proc Natl Acad Sci USA. 1992; 89(21):10405-9) The 153 amino acid SOD1 protein functions as a homodimer that binds copper and zinc and catalyzes the conversion of superoxide radicals to hydrogen peroxide and oxygen in 2 asymmetrical steps utilizing an essential copper atom in the active site of the enzyme (JD Rothstein, TDP-43 in amyotrophic lateral sclerosis: pathophysiology or patho-babel? Ann Neurol. 2007; 61(5):382-4.). In addition to being an antioxidant enzyme, human SOD1 protein has been reported to activate nuclear gene transcription following exposure to oxidative stress (C K Tsang et al., Superoxide dismutase 1 acts as a nuclear transcription factor to regulate oxidative stress resistance. Nat Commun. 2014; 5:3446.), to be involved in the regulation of RNA metabolism (Z. Butti & S A Patten, RNA Dysregulation in Amyotrophic Lateral Sclerosis. Front Genet. 2018; 9:712.; L Lu et al., Mutant Cu/Zn-superoxide dismutase associated with amyotrophic lateral sclerosis destabilizes vascular endothelial growth factor mRNA and downregulates its expression. J Neurosci. 2007; 27(30): 7929-38.), and to modulate the glucose sensing pathway to repress respiration (A R Reddi & V C Culotta, SOD1 integrates signals from oxygen and glucose to repress respiration. Cell. 2013; 152 (1-2): 224-35.). In 1993, Rosen et al. identified SOD1 mutations related to fatal adult-onset neurodegenerative cases of familial amyotrophic lateral sclerosis (fALS) (D R Rosen et al., Mutations in Cu/Zn superoxide dismutase gene are associated with familial amyotrophic lateral sclerosis. Nature. 1993; 362(6415):59-62.).

Amyotrophic lateral sclerosis (ALS) is a fatal motoneuronal disorder that causes progressive degeneration of upper and lower motor neurons in the primary motor cortex, brainstem, and spinal cord (A. Chio et al., Global epidemiology of amyotrophic lateral sclerosis: a systematic review of the published literature. Neuroepidemiology. 2013; 41(2): 118-30.; O. Hardiman et al., Amyotrophic lateral sclerosis. Nat Rev Dis Primers. 2017; 3:17071.; N. Nowicka et al., Risk Factors and Emerging Therapies in Amyotrophic Lateral Sclerosis. Int J Mol Sci. 2019; 20 (11).). The degeneration and loss of motor neurons cause progressive weakness and atrophy of skeletal muscles, which usually progress to paralysis and death within 3 to 5 years (Hardiman 2017). Currently, available therapies for ALS show only modest efficacy with limited improvement in outcomes. Approximately 15% to 20% of fALS can be associated with a genetic cause and has a slightly younger age of onset (47-53 years) compared to the sporadic ALS cases for which a median age of onset ranges from 58 to 63 years. Among the genetically defined ALS cases, about 15% are associated with dominantly inherited mutations in the SOD1 gene and to date, over 180 genetic variants of SOD1 have been identified in patients with ALS (O. Abel et al., ALSoD: A user-friendly online bioinformatics tool for amyotrophic lateral sclerosis genetics. Hum Mutat. 2012; 33(9):1345-51.; R A A van der Spek et al., The project MinE databrowser: bringing large-scale whole-genome sequencing in ALS to researchers and the public. Amyotroph Lateral Scler Frontotemporal Degener. 2019; 20 (5-6): 432-40.).

Although the exact disease-causing mechanism of SOD1 mutations remains incompletely understood, there is a consensus that there is a toxic gain-of-function leading to toxicity induced by aggregation of mutant SOD1 in neurons. Overexpression of mutant SOD1 in mice or rats recapitulates important aspects of human ALS, including loss of neuromuscular junction innervation and motor neuron death (L I Bruijn & D W Cleveland, Mechanisms of selective motor neuron death in ALS: insights from transgenic mouse models of motor neuron disease. Neuropathol Appl Neurobiol. 1996; 22(5):373-87.; ME Gurney et al., Motor neuron degeneration in mice that express a human Cu,Zn superoxide dismutase mutation. Science. 1994; 264(5166):1772-5.). Loss of SOD1, while resulting in eventual motor neuron dysfunction, does not result in motor neuron death (P M Andersen et al., Phenotypic heterogeneity in motor neuron disease patients with CuZn-superoxide dismutase mutations in Scandinavia. Brain. 1997; 120 (Pt 10):1723-37.; A G Reaume et al., Motor neurons in Cu/Zn superoxide dismutase-deficient mice develop normally but exhibit enhanced cell death after axonal injury. Nat Genet. 1996; 13 (1): 43-7.). Additionally, although changes in the levels of enzyme activity were initially believed to be the primary pathogenic mechanism, it was observed that disease severity does not correlate with levels of dismutase activity (Andersen 1997; D W Cleveland et al., Toxic mutants in Charcot's sclerosis. Nature. 1995; 378(6555):342-3.). Rather, the major effect of SOD1 mutations in ALS is linked to the protein aggregation and a prion-like propagation of misfolded molecules (M Berdynski et al., SOD1 mutations associated with amyotrophic lateral sclerosis analysis of variant severity. Sci Rep. 2022; 12(1):103.).

Given the toxic gain-of-function role of SOD1, lowering levels of SOD1 is predicted to be therapeutic in SOD1 ALS. Support of this hypothesis in SOD1 ALS patients is provided by the recently approved tofersen. Tofersen is an antisense oligonucleotide that causes SOD1 messenger RNA (mRNA) to be degraded. In a 28-week randomized VALOR Phase 3 trial, tofersen was associated with reductions in the total concentration of SOD1 protein in cerebrospinal fluid (CSF) and reductions in the concentration of neurofilament light chain (NfL) protein in plasma. These results are interpreted to suggest that reducing SOD1 mRNA potentially slows the underlying disease process. At 52 weeks, a combined analysis of VALOR and its open-label extension showed that participants who started tofersen at the beginning of VALOR had a smaller numeric decline in the ALSFRS-R score, the percentage of predicted slow vital capacity, and handheld dynamometry megascore compared to those who started tofersen in the open label extension 28 weeks later (T Milleret al., Phase 1-2 Trial of Antisense Oligonucleotide Tofersen for SOD1 ALS. N Engl J Med. 2020; 383(2):109-19.).

However, seven percent of tofersen recipients reported serious neurological adverse events (AEs) and its invasive dosing regimen of 3 biweekly doses followed by monthly doses all via intrathecal (IT) injection requiring lumbar puncture are further limiting to its modest efficacy. Thus there remains a need for therapeutics that can safely and more effectively inhibit SOD1 gene expression in ALS patients.

SUMMARY

There exists a need for novel RNA interference (RNAi) agents (termed RNAi agents, RNAi triggers, or triggers), e.g., double stranded RNAi agents such as siRNAs, that are able to selectively and efficiently inhibit the expression of a SOD1 gene, including for use as a therapeutic or medicament. Further, there exists a need for compositions of novel SOD1-specific RNAi agents for the treatment of diseases or disorders associated mutant SOD1 gene expression and/or disorders that can be mediated at least in part by a reduction in SOD1 gene expression.

The nucleotide sequences and chemical modifications of the SOD1 RNAi agents disclosed herein, as well as their combination with certain specific pharmacokinetic and pharmacodynamic (PK/PD) modulators suitable for selectively and efficiently delivering the SOD1 RNAi agents to relevant CNS cells in vivo, differ from those previously disclosed or known in the art. The SOD1 RNAi agents disclosed herein provide for highly potent and efficient inhibition of the expression of a SOD1 gene.

In general, the present disclosure features SOD1 gene-specific RNAi agents, compositions that include SOD1 RNAi agents, and methods for inhibiting expression of a SOD1 gene in vitro and/or in vivo using the SOD1 RNAi agents and compositions that include SOD1 RNAi agents described herein. The SOD1 RNAi agents described herein are able to selectively and efficiently decrease expression of a SOD1 gene, and thereby reduce the expression of the SOD1 enzyme.

The described SOD1 RNAi agents can be used in methods for therapeutic treatment (including preventative or prophylactic treatment) of symptoms and diseases including, but not limited to, various central nervous system diseases and neurodegenerative diseases (including ALS and Alzheimer's Disease).

In one aspect, the disclosure features RNAi agents for inhibiting expression of a SOD1 gene, wherein the RNAi agent includes a sense strand (also referred to as a passenger strand) and an antisense strand (also referred to as a guide strand). The sense strand and the antisense strand can be partially, substantially, or fully complementary to each other. The length of the RNAi agent sense strands described herein each can be 15 to 49 nucleotides in length. The length of the RNAi agent antisense strands described herein each can be 18 to 49 nucleotides in length. In some embodiments, the sense and antisense strands are independently 18 to 26 nucleotides in length. The sense and antisense strands can be either the same length or different lengths. In some embodiments, the sense and antisense strands are independently 21 to 26 nucleotides in length. In some embodiments, the sense and antisense strands are independently 21 to 24 nucleotides in length. In some embodiments, both the sense strand and the antisense strand are 21 nucleotides in length. In some embodiments, the antisense strands are independently 18, 19, 20, 21, 22, 23, 24, 25, 26, 27, 28, 29, or 30 nucleotides in length. In some embodiments, the sense strands are independently 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. The RNAi agents described herein, upon delivery to a cell expressing SOD1 such as endothelial cells, neurons, microglia, and astrocytes, inhibit the expression of one or more SOD1 gene variants in vivo and/or in vitro.

The SOD1 RNAi agents disclosed herein target a human SOD1 gene (see, e.g., SEQ ID NO:1). In some embodiments, the SOD1 RNAi agents disclosed herein target a portion of a SOD1 gene having the sequence of any of the sequences disclosed in Table 1.

In another aspect, the disclosure features compositions, including pharmaceutical compositions, that include one or more of the disclosed SOD1 RNAi agents that are able to selectively and efficiently decrease expression of an SOD1 gene. The compositions that include one or more SOD1 RNAi agents described herein can be administered to a subject, such as a human or animal subject, for the treatment (including prophylactic treatment or inhibition) of symptoms and diseases associated with SOD1 protein or enzyme levels.

Examples of SOD1 RNAi agent sense strands and antisense strands that can be used in a SOD1 RNAi agent are provided in Tables 3, 4, 5, and 6. Examples of SOD1 RNAi agent duplexes are provided in Tables 7A, 7B, 8, 9A, and 10. Examples of 19-nucleotide core stretch sequences that may consist of or may be included in the sense strands and antisense strands of certain SOD1 RNAi agents disclosed herein, are provided in Table 2.

In another aspect, the disclosure features methods for delivering SOD1 RNAi agents to neurons, astrocytes, microglia and endothelial cells in a subject, such as a mammal, in vivo. Also described herein are compositions for use in such methods. In some embodiments, disclosed herein are methods for delivering SOD1 RNAi agents to central nervous system cells (neurons, astrocytes, microglia and endothelial cells) to a subject in vivo. In some embodiments, the subject is a human subject.

The methods disclosed herein include the administration of one or more SOD1 RNAi agents to a subject, e.g., a human or animal subject, by any suitable means known in the art. The pharmaceutical compositions disclosed herein that include one or more SOD1 RNAi agents can be administered in a number of ways depending upon whether local or systemic treatment is desired. Administration can be, but is not limited to, for example, intravenous, intraarterial, subcutaneous, intraperitoneal, subdermal (e.g., via an implanted device), and intraparenchymal administration. In some embodiments, the pharmaceutical compositions described herein are administered by intrathecal injection or intracerebroventricular injection.

In some embodiments, it is desired that the SOD1 RNAi agents described herein inhibit the expression of an SOD1 gene in central nervous system cells.

The one or more SOD1 RNAi agents can be delivered to target cells or tissues using any oligonucleotide delivery technology known in the art. In some embodiments, a SOD1 RNAi agent is delivered to cells or tissues by covalently linking the RNAi agent to a targeting group or a lipid moiety.

A PK/PD modulator can be linked to the 3' or 5' end of a sense strand or an antisense strand of a SOD1 RNAi agent. In some embodiments, a PK/PD modulator is linked to the 3' or 5' end of the sense strand. In some embodiments, a PK/PD modulator is linked to the 5' end of the sense strand. In some embodiments, a PK/PD modulator is linked internally to a nucleotide on the sense strand and/or the antisense strand of the RNAi agent. In some embodiments, a PK/PD modulator is linked to the RNAi agent via a linker.

In another aspect, the disclosure features compositions that include one or more SOD1 RNAi agents that have the duplex structures disclosed in Tables 7A, 7B, 8, 9A, and 10.

The use of SOD1 RNAi agents provides methods for therapeutic (including prophylactic) treatment of diseases or disorders for which a reduction in SOD1 protein levels can provide a therapeutic benefit. The SOD1 RNAi agents disclosed herein can be used to treat various neurodegenerative diseases, including ALS and Alzheimer's disease. Such methods of treatment include administration of a SOD1 RNAi agent to a human being or animal having elevated or mutant SOD1 enzyme or SOD1 enzyme activity beyond desirable levels.

Definitions

As used herein, the terms "oligonucleotide" and "polynucleotide" mean a polymer of linked nucleosides each of which can be independently modified or unmodified.

As used herein, an "RNAi agent" (also referred to as an "RNAi trigger") means a chemical composition of matter that contains an RNA or RNA-like (e.g., chemically modified RNA) oligonucleotide molecule that is capable of degrading or inhibiting (e.g., degrades or inhibits under appropriate conditions) translation of messenger RNA (mRNA) transcripts of a target mRNA in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: small (or short) interfering RNAs (siRNAs), double stranded RNAs (dsRNA), micro RNAs (miRNAs), short hairpin RNAs (shRNA), and dicer substrates. The antisense strand of the RNAi agents described herein is at least partially complementary to the mRNA being targeted (i.e. SOD1 mRNA). RNAi agents can include one or more modified nucleotides and/or one or more non-phosphodiester linkages.

As used herein, the terms "silence," "reduce," "inhibit," "down-regulate," or "knockdown" when referring to expression of a given gene, mean that the expression of the gene, as measured by the level of RNA transcribed from the gene or the level of polypeptide, protein, or protein subunit translated from the mRNA in a cell, group of cells, tissue, organ, or subject in which the gene is transcribed, is reduced when the cell, group of cells, tissue, organ, or subject is treated with the RNAi agents described herein as compared to a second cell, group of cells, tissue, organ, or subject that has not or have not been so treated.

As used herein, the terms "sequence" and "nucleotide sequence" mean a succession or order of nucleobases or nucleotides, described with a succession of letters using standard nomenclature.

As used herein, a "base," "nucleotide base," or "nucleobase," is a heterocyclic pyrimidine or purine compound that is a component of a nucleotide, and includes the primary purine bases adenine and guanine, and the primary pyrimidine bases cytosine, thymine, and uracil. A nucleobase may further be modified to include, without limitation, universal bases, hydrophobic bases, promiscuous bases, size-expanded bases, and fluorinated bases. (See, e.g., Modified Nucleosides in Biochemistry, Biotechnology and Medicine, Herdewijn, P. ed. Wiley-VCH, 2008). The synthesis of such modified nucleobases (including phosphoramidite compounds that include modified nucleobases) is known in the art.

As used herein, and unless otherwise indicated, the term "complementary," when used to describe a first nucleobase or nucleotide sequence (e.g., RNAi agent sense strand or targeted mRNA) in relation to a second nucleobase or nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or otherwise suitable in vivo or in vitro conditions)) and form a duplex or double helical structure under certain standard conditions with an oligonucleotide that includes the second nucleotide sequence. The person of ordinary skill in the art would be able to select the set of conditions most appropriate for a hybridization test. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af, as defined herein, are complementary to U (or T) and identical to A for the purposes of determining identity or complementarity.

As used herein, "perfectly complementary" or "fully complementary" means that in a hybridized pair of nucleobase or nucleotide sequence molecules, all (100%) of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "partially complementary" means that in a hybridized pair of nucleobase or nucleotide sequence molecules, at least 70%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "substantially complementary" means that in a hybridized pair of nucleobase or nucleotide sequence molecules, at least 85%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, the terms "complementary," "fully complementary," "partially complementary," and "substantially complementary" are used with respect to the nucleobase or nucleotide matching between the sense strand and the antisense strand of an RNAi agent, or between the antisense strand of an RNAi agent and a sequence of an SOD1 mRNA.

As used herein, the term "substantially identical" or "substantial identity," as applied to a nucleic acid sequence means the nucleotide sequence (or a portion of a nucleotide sequence) has at least about 85% sequence identity or more, e.g., at least 90%, at least 95%, or at least 99% identity, compared to a reference sequence. Percentage of sequence identity is determined by comparing two optimally aligned sequences over a comparison window. The percentage is calculated by determining the number of positions at which the same type of nucleic acid base occurs in both sequences to yield the number of matched positions, dividing the number of matched positions by the total number of positions in the window of comparison and multiplying the result by 100 to yield the percentage of sequence identity. The inventions disclosed herein encompass nucleotide sequences substantially identical to those disclosed herein.

As used herein, the terms "treat," "treatment," and the like, mean the methods or steps taken to provide relief from or alleviation of the number, severity, and/or frequency of one or more symptoms of a disease in a subject. As used herein, "treat" and "treatment" may include the prevention, management, prophylactic treatment, and/or inhibition or reduction of the number, severity, and/or frequency of one or more symptoms of a disease in a subject.

As used herein, the phrase "introducing into a cell," when referring to an RNAi agent, means functionally delivering the RNAi agent into a cell. The phrase "functional delivery," means delivering the RNAi agent to the cell in a manner that enables the RNAi agent to have the expected biological activity, e.g., sequence-specific inhibition of gene expression.

Unless stated otherwise, use of the symbol ⌇ as used herein means that any group or groups may be linked thereto that is in accordance with the scope of the inventions described herein.

As used herein, the term "isomers" refers to compounds that have identical molecular formulae, but that differ in the nature or the sequence of bonding of their atoms or in the arrangement of their atoms in space. Isomers that differ in the arrangement of their atoms in space are termed "stereoisomers." Stereoisomers that are not mirror images of one another are termed "diastereoisomers," and stereoisomers that are non-superimposable mirror images are termed "enantiomers," or sometimes optical isomers. A carbon atom bonded to four non-identical substituents is termed a "chiral center."

As used herein, unless specifically identified in a structure as having a particular conformation, for each structure in which asymmetric centers are present and thus give rise to enantiomers, diastereomers, or other stereoisomeric configurations, each structure disclosed herein is intended to represent all such possible isomers, including their optically pure and racemic forms. For example, the structures disclosed herein are intended to cover mixtures of diastereomers as well as single stereoisomers.

As used in a claim herein, the phrase "consisting of" excludes any element, step, or ingredient not specified in the claim. When used in a claim herein, the phrase "consisting essentially of" limits the scope of a claim to the specified materials or steps and those that do not materially affect the basic and novel characteristic(s) of the claimed invention.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the environment (such as pH), as would be readily understood by the person of ordinary skill in the art. Correspondingly, compounds described herein with labile protons or basic atoms should also be understood to represent salt forms of the corresponding compound. Compounds described herein may be in a free acid, free base, or salt form. Pharmaceutically acceptable salts of the compounds described herein should be understood to be within the scope of the invention.

As used herein, the term "linked" or "conjugated" when referring to the connection between two compounds or molecules means that two compounds or molecules are joined by a covalent bond. Unless stated, the terms "linked" and "conjugated" as used herein may refer to the connection between a first compound and a second compound either with or without any intervening atoms or groups of atoms.

As used herein, the term "including" is used to herein mean, and is used interchangeably with, the phrase "including but not limited to." The term "or" is used herein to mean, and is used interchangeably with, the term "and/or," unless the context clearly indicates otherwise.

Unless otherwise defined, all technical and scientific terms used herein have the same meaning as commonly understood by one of ordinary skill in the art. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other objects, features, aspects, and advantages of the invention will be apparent from the following detailed description, accompanying figures, and from the claims.

DETAILED DESCRIPTION

RNAi Agents

Described herein are RNAi agents for inhibiting expression of the SOD1 (or SOD1) gene (referred to herein as SOD1 RNAi agents or SOD1 RNAi triggers). Each SOD1 RNAi agent disclosed herein comprises a sense strand and an antisense strand. The sense strand can be 15 to 49 nucleotides in length. The antisense strand can be 18 to 30 nucleotides in length. The sense and antisense strands can be either the same length or they can be different lengths. In some embodiments, the sense and antisense strands are each independently 18 to 27 nucleotides in length. In some embodiments, both the sense and antisense strands are each 21-26 nucleotides in length. In some embodiments, the sense and antisense strands are each 21-24 nucleotides in length. In some embodiments, the sense and antisense strands are each independently 19-21 nucleotides in length. In some embodiments, the sense strand is about 19 nucleotides in length while the antisense strand is about 21 nucleotides in length. In some embodiments, the sense strand is about 21 nucleotides in length while the antisense strand is about 23 nucleotides in length. In some embodiments, a sense strand is 23 nucleotides in length and an antisense strand is 21 nucleotides in length. In some embodiments, both the sense and antisense strands are each 21 nucleotides in length. In some embodiments, the RNAi agent sense strands are each independently 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. In some embodiments, the RNAi agent antisense strands are each independently 18, 19, 20, 21, 22, 23, 24, 25, 26, 27, 28, 29, or 30 nucleotides in length. In some embodiments, a double-stranded RNAi agent has a duplex length of about 16, 17, 18, 19, 20, 21, 22, 23 or 24 nucleotides.

Examples of nucleotide sequences used in forming SOD1 RNAi agents are provided in Tables 2, 3, 4, 5, 6, and 10. Examples of RNAi agent duplexes, that include the sense strand and antisense strand sequences in Tables 2, 3, 4, 5, 6, are shown in Tables 7A, 7B, 8, 9A, and 10.

In some embodiments, the region of perfect, substantial, or partial complementarity between the sense strand and the antisense strand is 16-26 (e.g., 16, 17, 18, 19, 20, 21, 22, 23, 24, 25, or 26) nucleotides in length and occurs at or near the 5' end of the antisense strand (e.g., this region may be separated from the 5' end of the antisense strand by 0, 1, 2, 3, or 4 nucleotides that are not perfectly, substantially, or partially complementary).

A sense strand of the SOD1 RNAi agents described herein includes at least 15 consecutive nucleotides that have at least 85% identity to a core stretch sequence (also referred to herein as a "core stretch" or "core sequence") of the same number of nucleotides in an SOD1 mRNA. In some embodiments, a sense strand core stretch sequence is 100% (perfectly) complementary or at least about 85% (substantially) complementary to a core stretch sequence in the antisense strand, and thus the sense strand core stretch sequence is typically perfectly identical or at least about 85% identical to a nucleotide sequence of the same length (sometimes referred to, e.g., as a target sequence) present in the SOD1 mRNA target. In some embodiments, this sense strand core stretch is 15, 16, 17, 18, 19, 20, 21, 22, or 23 nucleotides in length. In some embodiments, this sense strand core stretch is 17 nucleotides in length. In some embodiments, this sense strand core stretch is 19 nucleotides in length.

An antisense strand of a SOD1 RNAi agent described herein includes at least 16 consecutive nucleotides that have at least 85% complementarity to a core stretch of the same number of nucleotides in an SOD1 mRNA and to a core stretch of the same number of nucleotides in the corresponding sense strand. In some embodiments, an antisense strand core stretch is 100% (perfectly) complementary or at least about 85% (substantially) complementary to a nucleotide sequence (e.g., target sequence) of the same length present in the SOD1 mRNA target. In some embodiments, this antisense strand core stretch is 16, 17, 18, 19, 20, 21, 22, or 23 nucleotides in length. In some embodiments, this antisense strand core stretch is 19 nucleotides in length. In some embodiments, this antisense strand core stretch is 17 nucleotides in length. A sense strand core stretch sequence can be the same length as a corresponding antisense core sequence or it can be a different length.

The SOD1 RNAi agent sense and antisense strands anneal to form a duplex. A sense strand and an antisense strand of a SOD1 RNAi agent can be partially, substantially, or fully complementary to each other. Within the complementary duplex region, the sense strand core stretch sequence is at least 85% complementary or 100% complementary to the antisense core stretch sequence. In some embodiments, the sense strand core stretch sequence contains a sequence of at least 16, at least 17, at least 18, at least 19, at least 20, at least 21, at least 22, or at least 23 nucleotides that is at least 85% or 100% complementary to a corresponding 16, 17, 18, 19, 20, 21, 22, or 23 nucleotide sequence of the antisense strand core stretch sequence (i.e., the sense and antisense core stretch sequences of a SOD1RNAi agent have a region of at least 16, at least 17, at least 18, at least 19, at least 20, at least 21, at least 22, or at least 23 nucleotides that is at least 85% base paired or 100% base paired.)

In some embodiments, the antisense strand of a SOD1 RNAi agent disclosed herein differs by 0, 1, 2, or 3 nucleotides from any of the antisense strand sequences in Table 2 or Table 3. In some embodiments, the sense strand of a SOD1 RNAi agent disclosed herein differs by 0, 1, 2, or 3 nucleotides from any of the sense strand sequences in Table 2, Table 4, Table 5, Table 6, Table 6a, or Table 10.

In some embodiments, the sense strand and/or the antisense strand can optionally and independently contain an additional 1, 2, 3, 4, 5, or 6 nucleotides (extension) at the 3' end, the 5' end, or both the 3' and 5' ends of the core stretch sequences. The antisense strand additional nucleotides, if present, may or may not be complementary to the corresponding sequence in the SOD1 mRNA. The sense strand additional nucleotides, if present, may or may not be identical to the corresponding sequence in the SOD1 mRNA. The antisense strand additional nucleotides, if present, may or may not be complementary to the corresponding sense strand's additional nucleotides, if present.

As used herein, an extension comprises 1, 2, 3, 4, 5, or 6 nucleotides at the 5' and/or 3' end of the sense strand core stretch sequence and/or antisense strand core stretch sequence. The extension nucleotides on a sense strand may or may not be complementary to nucleotides, either core stretch sequence nucleotides or extension nucleotides, in the corresponding antisense strand. Conversely, the extension nucleotides on an antisense strand may or may not be complementary to nucleotides, either core stretch nucleotides or extension nucleotides, in the corresponding sense strand. In some embodiments, both the sense strand and the antisense strand of an RNAi agent contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, a SOD1 RNAi agent has an antisense strand having a 3' extension and a sense strand having a 5' extension. In some embodiments, the extension nucleotide(s) are unpaired and form an overhang. As used herein, an "overhang" refers to a stretch of one or more unpaired nucleotides located at a terminal end of either the sense strand or the antisense strand that does not form part of the hybridized or duplexed portion of an RNAi agent disclosed herein.

In some embodiments, a SOD1 RNAi agent comprises an antisense strand having a 3' extension of 1, 2, 3, 4, 5, or 6 nucleotides in length. In other embodiments, a SOD1 RNAi agent comprises an antisense strand having a 3' extension of 1, 2, or 3 nucleotides in length. In some embodiments, one or more of the antisense strand extension nucleotides comprise nucleotides that are complementary to the corresponding SOD1 mRNA sequence. In some embodiments, one or more of the antisense strand extension nucleotides comprise nucleotides that are not complementary to the corresponding SOD1 mRNA sequence.

In some embodiments, a SOD1 RNAi agent comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides that correspond to or are the identical to nucleotides in the SOD1 mRNA sequence. In some embodiments, the 3' sense strand extension includes or consists of one of the following sequences, but is not limited to: T, UT, TT, UU, UUT, TTT, or TTTT (each listed 5' to 3').

A sense strand can have a 3' extension and/or a 5' extension. In some embodiments, a SOD1 RNAi agent comprises a sense strand having a 5' extension of 1, 2, 3, 4, 5, or 6 nucleotides in length. In some embodiments, one or more of the sense strand extension nucleotides comprise nucleotides that correspond to or are identical to nucleotides in the SOD1 mRNA sequence.

Examples of sequences used in forming SOD1 RNAi agents are provided in Tables 2, 3, 4, 5, 6, and 10. In some embodiments, a SOD1 RNAi agent antisense strand includes a sequence of any of the sequences in Tables 2, 3, or 10. In certain embodiments, a SOD1 RNAi agent antisense strand comprises or consists of any one of the modified sequences in Table 3. In some embodiments, a SOD1 RNAi agent antisense strand includes the sequence of nucleotides (from 5' end→3' end) 1-17, 2-15, 2-17, 1-18, 2-18, 1-19, 2-19, 1-20, 2-20, 1-21, or 2-21, of any of the sequences in Tables 2 or 3. In some embodiments, a SOD1 RNAi agent sense strand includes the sequence of any of the sequences in Tables 2, 4, 5, or 6. In some embodiments, a SOD1 RNAi agent sense strand includes the sequence of nucleotides (from 5' end→3' end) 1-18, 1-19, 1-20, 1-21, 2-19, 2-20, 2-21, 3-20, 3-21, or 4-21 of any of the sequences in Tables 2, 4, 5, or 6. In certain embodiments, a SOD1 RNAi agent sense strand comprises or consists of a modified sequence of any one of the modified sequences in Table 4, 5, 6, or 10.

In some embodiments, the sense and antisense strands of the RNAi agents described herein contain the same number of nucleotides. In some embodiments, the sense and antisense strands of the RNAi agents described herein contain different numbers of nucleotides. In some embodiments, the sense strand 5' end and the antisense strand 3' end of an RNAi agent form a blunt end. In some embodiments, the sense strand 3' end and the antisense strand 5' end of an RNAi agent form a blunt end. In some embodiments, both ends of an RNAi agent form blunt ends. In some embodiments, neither end of an RNAi agent is blunt-ended. As used herein a "blunt end" refers to an end of a double stranded RNAi agent in which the terminal nucleotides of the two annealed strands are complementary (form a complementary base-pair).

In some embodiments, the sense strand 5' end and the antisense strand 3' end of an RNAi agent form a frayed end. In some embodiments, the sense strand 3' end and the antisense strand 5' end of an RNAi agent form a frayed end. In some embodiments, both ends of an RNAi agent form a frayed end. In some embodiments, neither end of an RNAi agent is a frayed end. As used herein a frayed end refers to an end of a double stranded RNAi agent in which the terminal nucleotides of the two annealed strands form a pair (i.e., do not form an overhang) but are not complementary (i.e. form a non-complementary pair). In some embodiments, one or more unpaired nucleotides at the end of one strand of a double stranded RNAi agent form an overhang. The unpaired nucleotides may be on the sense strand or the antisense strand, creating either 3' or 5' overhangs. In some embodiments, the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends. Typically, when present, overhangs are located at the 3' terminal ends of the sense strand, the antisense strand, or both the sense strand and the antisense strand.

The SOD1 RNAi agents disclosed herein may also be comprised of one or more modified nucleotides. In some embodiments, substantially all of the nucleotides of the sense strand and substantially all of the nucleotides of the antisense strand of the SOD1 RNAi agent are modified nucleotides. The SOD1 RNAi agents disclosed herein may further be comprised of one or more modified internucleoside linkages, e.g., one or more phosphorothioate linkages. In some embodiments, a SOD1 RNAi agent contains one or more modified nucleotides and one or more modified internucleoside linkages. In some embodiments, a 2'-modified nucleotide is combined with modified internucleoside linkage.

In some embodiments, a SOD1 RNAi agent is prepared or provided as a salt, mixed salt, or a free-acid. In some embodiments, a SOD1 RNAi agent is prepared as a pharmaceutically acceptable salt. In some embodiments, a SOD1 RNAi agent is prepared as a pharmaceutically acceptable sodium salt. Such forms that are well known in the art are within the scope of the inventions disclosed herein.

Modified Nucleotides

Modified nucleotides, when used in various oligonucleotide constructs, can preserve activity of the compound in cells while at the same time increasing the serum stability of these compounds, and can also minimize the possibility of activating interferon activity in humans upon administration of the oligonucleotide construct.

In some embodiments, a SOD1 RNAi agent contains one or more modified nucleotides. As used herein, a "modified nucleotide" is a nucleotide other than a ribonucleotide (2'-hydroxyl nucleotide). In some embodiments, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides can include, but are not limited to, deoxyribonucleotides, nucleotide mimics, abasic nucleotides, 2'-modified nucleotides, inverted nucleotides, modified nucleobase-comprising nucleotides, bridged nucleotides, peptide nucleic acids (PNAs), 2',3'-seco nucleotide mimics (unlocked nucleobase analogues), locked nucleotides, 3'-O-methoxy (2' internucleoside linked) nucleotides, 2'-F-Arabino nucleotides, 5'-Me, 2'-fluoro nucleotide, morpholino nucleotides, vinyl phosphonate deoxyribonucleotides, vinyl phosphonate containing nucleotides, and cyclopropyl phosphonate containing nucleotides. 2'-modified nucleotides (i.e., a nucleotide with a group other than a hydroxyl group at the 2' position of the five-membered sugar ring) include, but are not limited to, 2'-O-methyl nucleotides (also referred to herein or in the art as 2'-methoxy nucleotides), 2'-fluoro nucleotides (also referred to herein or in the art as 2'-deoxy-2'-fluoro nucleotides), 2'-deoxy nucleotides, 2'-methoxyethyl (2'-O-2-methoxylethyl) nucleotides (also referred herein or in the art as 2'-MOE nucleotides), 2'-amino nucleotides, and 2'-alkyl nucleotides. It is not necessary for all positions in a given compound to be uniformly modified. Conversely, more than one modification can be incorporated in a single SOD1 RNAi agent or even in a single nucleotide thereof. The SOD1 RNAi agent sense strands and antisense strands can be synthesized and/or modified by methods known in the art. Modification at one nucleotide is independent of modification at another nucleotide.

Modified nucleobases include synthetic and natural nucleobases, such as 5-substituted pyrimidines, 6-azapyrimidines and N-2, N-6 and 0-6 substituted purines, (e.g., 2-aminopropyladenine, 5-propynyluracil, or 5-propynylcytosine), 5-methylcytosine (5-me-C), 5-hydroxymethyl cytosine, inosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine.

In some embodiments, the 5' and/or 3' end of the antisense strand can include abasic residues (Ab), which can also be referred to as an "abasic site" or "abasic nucleotide." An abasic residue (Ab) is a nucleotide or nucleoside that lacks a nucleobase at the 1' position of the sugar moiety. (See, e.g., U.S. Pat. No. 5,998,203). In some embodiments, an abasic residue can be placed internally in a nucleotide sequence. In some embodiments, Ab or AbAb can be added to the 3' end of the antisense strand. In some embodiments, the 5' end of the sense strand can include one or more additional abasic residues (e.g., (Ab) or (AbAb)). In some embodiments, UUAb, UAb, or Ab are added to the 3' end of the sense strand. In some embodiments, an abasic (deoxyribose) residue can be replaced with a ribitol (abasic ribose) residue.

In some embodiments, all or substantially all of the nucleotides of an RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides (i.e., unmodified). As used herein, a sense strand wherein substantially all of the nucleotides present are modified nucleotides is a sense strand having two or fewer (i.e., 0, 1, or 2) nucleotides in the sense strand being unmodified ribonucleotides. As used herein, an antisense strand wherein substantially all of the nucleotides present are modified nucleotides is an antisense strand having two or fewer (i.e., 0, 1, or 2) nucleotides in the antisense strand being unmodified ribonucleotides. In some embodiments, one or more nucleotides of an RNAi agent is an unmodified ribonucleotide. Chemical structures for certain modified nucleotides are set forth in Table 11 herein.

Modified Internucleoside Linkages

In some embodiments, one or more nucleotides of a SOD1 RNAi agent are linked by non-standard linkages or backbones (i.e., modified internucleoside linkages or modified backbones). Modified internucleoside linkages or backbones include, but are not limited to, phosphorothioate groups (represented herein as a lower case "s"), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and $CH_2$ components.

In some embodiments, a sense strand of a SOD1 RNAi agent can contain 1, 2, 3, 4, 5, or 6 phosphorothioate linkages, an antisense strand of a SOD1 RNAi agent can contain 1, 2, 3, 4, 5, or 6 phosphorothioate linkages, or both the sense strand and the antisense strand independently can contain 1, 2, 3, 4, 5, or 6 phosphorothioate linkages. In some embodiments, a sense strand of a SOD1 RNAi agent can contain 1, 2, 3, or 4 phosphorothioate linkages, an antisense strand of a SOD1 RNAi agent can contain 1, 2, 3, or 4 phosphorothioate linkages, or both the sense strand and the antisense strand independently can contain 1, 2, 3, or 4 phosphorothioate linkages.

In some embodiments, a SOD1 RNAi agent sense strand contains at least two phosphorothioate internucleoside linkages. In some embodiments, the phosphorothioate internucleoside linkages are between the nucleotides at positions 1-3 from the 3' end of the sense strand. In some embodiments, one phosphorothioate internucleoside linkage is at the 5' end of the sense strand nucleotide sequence, and another phosphorothioate linkage is at the 3' end of the sense strand nucleotide sequence. In some embodiments, two phosphorothioate internucleoside linkage are located at the 5' end of the sense strand, and another phosphorothioate linkage is at the 3' end of the sense strand. In some embodiments, the sense strand does not include any phosphorothioate internucleoside linkages between the nucleotides, but contains one, two, or three phosphorothioate linkages between the terminal nucleotides on both the 5' and 3' ends and the optionally present inverted abasic residue terminal caps. In some embodiments, a targeting ligand is linked to the sense strand via a phosphorothioate linkage.

In some embodiments, a SOD1 RNAi agent antisense strand contains four phosphorothioate internucleoside linkages. In some embodiments, the four phosphorothioate internucleoside linkages are between the nucleotides at positions 1-3 from the 5' end of the antisense strand and between the nucleotides at positions 19-21, 20-22, 21-23, 22-24, 23-25, or 24-26 from the 5' end. In some embodiments, three phosphorothioate internucleoside linkages are located between positions 1-4 from the 5' end of the antisense strand, and a fourth phosphorothioate internucleoside linkage is located between positions 20-21 from the 5' end of the antisense strand. In some embodiments, a SOD1 RNAi agent contains at least three or four phosphorothioate internucleoside linkages in the antisense strand.

Capping Residues or Moieties

In some embodiments, the sense strand may include one or more capping residues or moieties, sometimes referred to in the art as a "cap," a "terminal cap," or a "capping residue." As used herein, a "capping residue" is a non-nucleotide compound or other moiety that can be incorporated at one or more termini of a nucleotide sequence of an RNAi agent disclosed herein. A capping residue can provide the RNAi agent, in some instances, with certain beneficial properties, such as, for example, protection against exonuclease degradation. In some embodiments, inverted abasic residues (invAb) (also referred to in the art as "inverted abasic sites") are added as capping residues (see Table 11). (See, e.g., F. Czauderna, Nucleic Acids Res., 2003, 31(11), 2705-16). Capping residues are generally known in the art, and include, for example, inverted abasic residues as well as carbon chains such as a terminal $C_3H_7$ (propyl), $C_6H_{13}$ (hexyl), or $C_{12}H_{25}$ (dodecyl) groups. In some embodiments, a capping residue is present at either the 5' terminal end, the 3' terminal end, or both the 5' and 3' terminal ends of the sense strand. In some embodiments, the 5' end and/or the 3' end of the sense strand may include more than one inverted abasic deoxyribose moiety as a capping residue.

In some embodiments, one or more inverted abasic residues (invAb) are added to the 3' end of the sense strand. In some embodiments, one or more inverted abasic residues (invAb) are added to the 5' end of the sense strand. In some embodiments, one or more inverted abasic residues or inverted abasic sites are inserted between a targeting ligand and the nucleotide sequence of the sense strand of the RNAi agent. In some embodiments, the inclusion of one or more inverted abasic residues or inverted abasic sites at or near the terminal end or terminal ends of the sense strand of an RNAi agent allows for enhanced activity or other desired properties of an RNAi agent.

In some embodiments, one or more inverted abasic residues (invAb) are added to the 5' end of the sense strand. In some embodiments, one or more inverted abasic residues can be inserted between a targeting ligand and the nucleotide sequence of the sense strand of the RNAi agent. The inverted abasic residues may be linked via phosphate, phosphorothioate (e.g., shown herein as (invAb)s)), or other internucleoside linkages. In some embodiments, the inclusion of one or more inverted abasic residues at or near the terminal end or terminal ends of the sense strand of an RNAi agent may allow for enhanced activity or other desired properties of an RNAi agent. In some embodiments, an inverted abasic (deoxyribose) residue can be replaced with an inverted ribitol (abasic ribose) residue. In some embodiments, the 3' end of the antisense strand core stretch sequence, or the 3' end of the antisense strand sequence, may include an inverted abasic residue. The chemical structures for inverted abasic deoxyribose residues are shown in Table 11 below.

SOD1 RNAi Agents

The SOD1 RNAi agents disclosed herein are designed to target specific positions on a SOD1 gene (e.g., SEQ ID NO:1 (NM_000454.5)). As defined herein, an antisense strand sequence is designed to target a SOD1 gene at a given position on the gene when the 5' terminal nucleobase of the antisense strand is aligned with a position that is 21 nucleotides downstream (towards the 3' end) from the position on the gene when base pairing to the gene. For example, as illustrated in Tables 1 and 2 herein, an antisense strand sequence designed to target a SOD1 gene at position 304 requires that when base pairing to the gene, the 5' terminal nucleobase of the antisense strand is aligned with position 324 of a SOD1 gene.

As provided herein, a SOD1 RNAi agent does not require that the nucleobase at position 1 (5'→3') of the antisense strand be complementary to the gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. For example, for a SOD1 RNAi agent disclosed herein that is designed to target position 304 of a SOD1 gene, the 5' terminal nucleobase of the antisense strand of the of the SOD1 RNAi agent must be aligned with position 324 of the gene; however, the 5' terminal nucleobase of the antisense strand may be, but is not required to be, complementary to position 324 of a SOD1 gene, provided that there is at least 85% complementarity (e.g., at least 85, 86, 87, 88, 89, 90, 91, 92, 93, 94, 95, 96, 97, 98, 99, or 100% complementarity) of the antisense strand and the gene transcript across a core stretch sequence of at least 16 consecutive nucleotides. As shown by, among other things, the various examples disclosed herein, the specific site of binding of the gene by the antisense strand of the SOD1 RNAi agent (e.g., whether the SOD1 RNAi agent is designed to target a SOD1 gene at position 304, at position 264, at position 785, or at some other position) is an important factor to the level of inhibition achieved by the SOD1 RNAi agent. (See, e.g., Kamola et al., *The siRNA Non-seed Region and Its Target Sequences are Auxiliary Determinants of Off-Target Effects*, PLOS Computational Biology, 11(12), FIG. 1 (2015)).

In some embodiments, the SOD1 RNAi agents disclosed herein target a SOD1 gene at or near the positions of the SOD1 sequence shown in Table 1. In some embodiments, the antisense strand of a SOD1 RNAi agent disclosed herein includes a core stretch sequence that is fully, substantially, or at least partially complementary to a target SOD1 19-mer sequence disclosed in Table 1.

TABLE 1

SOD1 19-mer mRNA Target Sequences (taken from homo sapiens Superoxide dismutase 1 (SOD1) transcript, GenBank NM_000454.5 (SEQ ID NO: 1))

| SEQ ID No. | SOD1 19-mer Target Sequences (5' → 3') | Corresponding Positions of Sequence on SEQ ID NO: 1 | Targeted Gene Position (as referred to herein) |
|---|---|---|---|
| 290 | UCACUUUAAUCCUCUAUCC | 266-284 | 264 |
| 295 | UAACUCAUCUGUUAUCCUG | 573-591 | 571 |

TABLE 1-continued

SOD1 19-mer mRNA Target Sequences (taken from homo sapiens Superoxide dismutase 1 (SOD1) transcript, GenBank NM_000454.5 (SEQ ID NO: 1))

| SEQ ID No. | SOD1 19-mer Target Sequences (5' → 3') | Corresponding Positions of Sequence on SEQ ID NO: 1 | Targeted Gene Position (as referred to herein) |
|---|---|---|---|
| 349 | UGAAGAUUCUGUGAUCUCA | 377-395 | 375 |
| 304 | CCCAGUGCAGGGCAUCAUC | 116-134 | 114 |
| 309 | AGCAGAAGGAAAGUAAUGG | 142-160 | 140 |
| 314 | AAGUAAUGGACCAGUGAAG | 152-170 | 150 |
| 319 | CUGCAUGGAUUCCAUGUUC | 204-222 | 202 |
| 322 | UGCAUGGAUUCCAUGUUCA | 205-223 | 203 |
| 326 | GCAUGGAUUCCAUGUUCAU | 206-224 | 204 |
| 332 | UCCAUGUUCAUGAGUUUGG | 214-232 | 212 |
| 337 | CAGGUCCUCACUUUAAUCC | 259-277 | 257 |
| 342 | GAUGAAGAGAGGCAUGUUG | 306-324 | 304 |
| 345 | AUUGAAGAUUCUGUGAUCU | 375-393 | 373 |
| 349 | UGAAGAUUCUGUGAUCUCA | 377-395 | 375 |
| 355 | UGGUGGUCCAUGAAAAAGC | 430-448 | 428 |
| 358 | AUGAAAAAGCAGAUGACUU | 439-457 | 437 |
| 364 | UGAAAAAGCAGAUGACUUG | 440-458 | 438 |
| 369 | GUGGAAAUGAAGAAAGUAC | 466-484 | 464 |
| 374 | GGCUUGUGGUGUAAUUGGG | 512-530 | 510 |
| 379 | AACAUUCCCUUGGAUGUAG | 542-560 | 540 |
| 384 | UUCCCUUGGAUGUAGUCUG | 546-564 | 544 |
| 389 | CUUAACUCAUCUGUUAUCC | 571-589 | 569 |
| 392 | UUAACUCAUCUGUUAUCCU | 572-590 | 570 |
| 398 | UAACUCAUCUGUUAUCCUG | 573-591 | 571 |
| 403 | AACUCAUCUGUUAUCCUGC | 574-592 | 572 |
| 408 | CAUCUGUUAUCCUGCUAGC | 578-596 | 576 |
| 413 | UCUGUUAUCCUGCUAGCUG | 580-598 | 578 |
| 416 | UAUCCUGCUAGCUGUAGAA | 585-603 | 583 |
| 422 | CCUGCUAGCUGUAGAAAUG | 588-606 | 586 |
| 425 | UGCUAGCUGUAGAAAUGUA | 590-608 | 588 |
| 429 | GCUAGCUGUAGAAAUGUAU | 591-609 | 589 |
| 435 | UAGCUGUAGAAAUGUAUCC | 593-611 | 591 |
| 440 | GCUGUAGAAAUGUAUCCUG | 595-613 | 593 |
| 443 | CUGUAGAAAUGUAUCCUGA | 596-614 | 594 |
| 447 | AAUGUAUCCUGAUAAACAU | 603-621 | 601 |
| 451 | CUGAUAAACAUUAAACACU | 611-629 | 609 |
| 455 | ACAUUAAACACUGUAAUCU | 618-636 | 616 |
| 459 | AUUAAACACUGUAAUCUUA | 620-638 | 618 |
| 465 | CUUUAAAGUACCUGUAGUG | 670-688 | 668 |
| 470 | ACUGAUUUAUGAUCACUUG | 693-711 | 691 |
| 473 | AUGAUCACUUGGAAGAUUU | 701-719 | 699 |
| 477 | AUCACUUGGAAGAUUUGUA | 704-722 | 702 |
| 481 | UGGAAGAUUUGUAUAGUUU | 710-728 | 708 |
| 485 | GUUAAAAUGUCUGUUUCAA | 740-758 | 738 |
| 489 | AUGUCUGUUUCAAUGACCU | 746-764 | 744 |
| 493 | GUUUCAAUGACCUGUAUUU | 752-770 | 750 |
| 497 | CCUGUAUUUUGCCAGACUU | 762-780 | 760 |
| 501 | AAAUCACAGAUGGGUAUUA | 781-799 | 779 |
| 505 | ACAGAUGGGUAUUAAACUU | 786-804 | 784 |
| 511 | CAGAUGGGUAUUAAACUUG | 787-805 | 785 |
| 514 | AGAUGGGUAUUAAACUUGU | 788-806 | 786 |
| 518 | AUGGGUAUUAAACUUGUCA | 790-808 | 788 |

*Homo sapiens* Superoxide dismutase (SOD1), GenBank NM_000454.5 (SEQ ID NO:1), gene transcript (895 bases):

```
  1 gcgtcgtagt ctcctgcagc gtctgggggtt tccgttgcag
    tcctcggaac caggacctcg
 61 gcgtggccta gcgagttatg gcgacgaagg ccgtgtgcgt
    gctgaagggc gacggcccag
121 tgcagggcat catcaatttc gagcagaagg aaagtaatgg
    accagtgaag gtgtggggaa
181 gcattaaagg actgactgaa ggcctgcatg gattccatgt
    tcatgagttt ggagataata
241 cagcaggctg taccagtgca ggtcctcact ttaatcctct
    atccagaaaa cacggtgggc
301 caaaggatga agagaggcat gttggagact gggcaatgt
    gactgctgac aaagatggtg
361 tggccgatgt gtcattgaa gattctgtga tctcactctc
    aggagaccat tgcatcattg
```

```
421  gccgcacact  ggtggtccat  gaaaaagcag  atgacttggg caaaggtgga  aatgaagaaa 481  gtacaaagac  aggaaacgct  ggaagtcgtt  tggcttgtgg tgtaattggg  atcgcccaat 541  aaacattccc  ttggatgtag  tctgaggccc  cttaactcat ctgttatcct  gctagctgta 601  gaaatgtatc  ctgataaaca  ttaaacactg  taatcttaaa agtgtaattg  tgtgactttt 661  tcagagttgc  tttaaagtac  ctgtagtgag  aaactgattt atgatcactt  ggaagatttg 721  tatagtttta  taaaactcag  ttaaaatgtc  tgtttcaatg acctgtattt  tgccagactt 781  aaatcacaga  tgggtattaa  acttgtcaga  atttctttgt cattcaagcc  tgtgaataaa 841  aaccctgtat  ggcacttatt  atgaggctat  taaaagaatc caaattcaaa  ctaaa
```

In some embodiments, a SOD1 RNAi agent includes an antisense strand wherein position 19 of the antisense strand (5'→3') is capable of forming a base pair with position 1 of a 19-mer target sequence disclosed in Table 1. In some embodiments, a SOD1 agent includes an antisense strand wherein position 1 of the antisense strand (5'→3') is capable of forming a base pair with position 19 of a 19-mer target sequence disclosed in Table 1.

In some embodiments, a SOD1 agent includes an antisense strand wherein position 2 of the antisense strand (5'→3') is capable of forming a base pair with position 18 of a 19-mer target sequence disclosed in Table 1. In some embodiments, a SOD1 agent includes an antisense strand wherein positions 2 through 18 of the antisense strand (5'→3') are capable of forming base pairs with each of the respective complementary bases located at positions 18 through 2 of the 19-mer target sequence disclosed in Table 1.

For the RNAi agents disclosed herein, the nucleotide at position 1 of the antisense strand (from 5' end→3' end) can be perfectly complementary to a SOD1 gene, or can be non-complementary to a SOD1 gene. In some embodiments, the nucleotide at position 1 of the antisense strand (from 5' end→3' end) is a U, A, or dT. In some embodiments, the nucleotide at position 1 of the antisense strand (from 5' end→3' end) forms an A:U or U:A base pair with the sense strand.

In some embodiments, a SOD1 RNAi agent antisense strand comprises the sequence of nucleotides (from 5' end→3' end) 2-18 or 2-19 of any of the antisense strand sequences in Table 2 or Table 3. In some embodiments, a SOD1 RNAi sense strand comprises the sequence of nucleotides (from 5' end→3' end) 1-17, 1-18, or 2-18 of any of the sense strand sequences in Table 2, Table 4, Table 5, Table 6, or Table 6a.

In some embodiments, a SOD1 RNAi agent is comprised of (i) an antisense strand comprising the sequence of nucleotides (from 5' end→3' end) 2-18 or 2-19 of any of the antisense strand sequences in Table 2 or Table 3, and (ii) a sense strand comprising the sequence of nucleotides (from 5' end→3' end) 1-17 or 1-18 of any of the sense strand sequences in Table 2, Table 4, Table 5, Table 6, or Table 6a.

In some embodiments, the SOD1 RNAi agents include core 19-mer nucleotide sequences shown in the following Table 2.

Table 2. SOD1 RNAi Agent Antisense Strand and Sense Strand Core Stretch Base Sequences (N=any Nucleobase; I=inosine (hypoxanthine nucleobase)

TABLE 2

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 54 | UGAUAGAGGAUUAAAGUGA | 288 | UCACUUUAAUCCUCUAUCA | 266-284 | 264 |
| 55 | AGAUAGAGGAUUAAAGUGA | 289 | UCACUUUAAUCCUCUAUCU | 266-284 | 264 |
| 56 | GGAUAGAGGAUUAAAGUGA | 290 | UCACUUUAAUCCUCUAUCC | 266-284 | 264 |
| 57 | NGAUAGAGGAUUAAAGUGA | 291 | UCACUUUAAUCCUCUAUCN | 266-284 | 264 |
| 58 | NGAUAGAGGAUUAAAGUGN | 292 | NCACUUUAAUCCUCUAUCN | 266-284 | 264 |
| 59 | UAGGAUAACAGAUGAGUUA | 293 | UAACUCAUCUGUUAUCCUA | 573-591 | 571 |
| 60 | AAGGAUAACAGAUGAGUUA | 294 | UAACUCAUCUGUUAUCCUU | 573-591 | 571 |
| 61 | CAGGAUAACAGAUGAGUUA | 295 | UAACUCAUCUGUUAUCCUG | 573-591 | 571 |
| 62 | NAGGAUAACAGAUGAGUUA | 296 | UAACUCAUCUGUUAUCCUN | 573-591 | 571 |
| 63 | NAGGAUAACAGAUGAGUUN | 297 | NAACUCAUCUGUUAUCCUN | 573-591 | 571 |
| 64 | UGAGAUCACAGAAUCUUCA | 298 | UGAAGAUUCUGUGAUCUCA | 377-395 | 375 |

TABLE 2-continued

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 65 | AGAGAUCACAGAAUCUUCA | 299 | UGAAGAUUCUGUGAUCUCU | 377-395 | 375 |
| 66 | NGAGAUCACAGAAUCUUCA | 300 | UGAAGAUUCUGUGAUCUCN | 377-395 | 375 |
| 67 | NGAGAUCACAGAAUCUUCN | 301 | NGAAGAUUCUGUGAUCUCN | 377-395 | 375 |
| 68 | UAUGAUGCCCUGCACUGGG | 302 | CCCAGUGCAGGGCAUCAUA | 116-134 | 114 |
| 69 | AAUGAUGCCCUGCACUGGG | 303 | CCCAGUGCAGGGCAUCAUU | 116-134 | 114 |
| 70 | GAUGAUGCCCUGCACUGGG | 304 | CCCAGUGCAGGGCAUCAUC | 116-134 | 114 |
| 71 | NAUGAUGCCCUGCACUGGG | 305 | CCCAGUGCAGGGCAUCAUN | 116-134 | 114 |
| 72 | NAUGAUGCCCUGCACUGGN | 306 | NCCAGUGCAGGGCAUCAUN | 116-134 | 114 |
| 73 | UCAUUACUUUCCUUCUGCU | 307 | AGCAGAAGGAAAGUAAUGA | 142-160 | 140 |
| 74 | ACAUUACUUUCCUUCUGCU | 308 | AGCAGAAGGAAAGUAAUGU | 142-160 | 140 |
| 75 | CCAUUACUUUCCUUCUGCU | 309 | AGCAGAAGGAAAGUAAUGG | 142-160 | 140 |
| 76 | NCAUUACUUUCCUUCUGCU | 310 | AGCAGAAGGAAAGUAAUGN | 142-160 | 140 |
| 77 | NCAUUACUUUCCUUCUGCN | 311 | NGCAGAAGGAAAGUAAUGN | 142-160 | 140 |
| 78 | UUUCACUGGUCCAUUACUU | 312 | AAGUAAUGGACCAGUGAAA | 152-170 | 150 |
| 79 | AUUCACUGGUCCAUUACUU | 313 | AAGUAAUGGACCAGUGAAU | 152-170 | 150 |
| 80 | CUUCACUGGUCCAUUACUU | 314 | AAGUAAUGGACCAGUGAAG | 152-170 | 150 |
| 81 | NUUCACUGGUCCAUUACUU | 315 | AAGUAAUGGACCAGUGAAN | 152-170 | 150 |
| 82 | NUUCACUGGUCCAUUACUN | 316 | NAGUAAUGGACCAGUGAAN | 152-170 | 150 |
| 83 | UAACAUGGAAUCCAUGCAG | 317 | CUGCAUGGAUUCCAUGUUA | 204-222 | 202 |
| 84 | AAACAUGGAAUCCAUGCAG | 318 | CUGCAUGGAUUCCAUGUUU | 204-222 | 202 |
| 85 | GAACAUGGAAUCCAUGCAG | 319 | CUGCAUGGAUUCCAUGUUC | 204-222 | 202 |
| 86 | NAACAUGGAAUCCAUGCAG | 320 | CUGCAUGGAUUCCAUGUUN | 204-222 | 202 |
| 87 | NAACAUGGAAUCCAUGCAN | 321 | NUGCAUGGAUUCCAUGUUN | 204-222 | 202 |
| 88 | UGAACAUGGAAUCCAUGCA | 322 | UGCAUGGAUUCCAUGUUCA | 205-223 | 203 |
| 89 | AGAACAUGGAAUCCAUGCA | 323 | UGCAUGGAUUCCAUGUUCU | 205-223 | 203 |
| 90 | NGAACAUGGAAUCCAUGCA | 324 | UGCAUGGAUUCCAUGUUCN | 205-223 | 203 |
| 91 | NGAACAUGGAAUCCAUGCN | 325 | NGCAUGGAUUCCAUGUUCN | 205-223 | 203 |
| 92 | AUGAACAUGGAAUCCAUGC | 326 | GCAUGGAUUCCAUGUUCAU | 206-224 | 204 |
| 93 | UUGAACAUGGAAUCCAUGC | 327 | GCAUGGAUUCCAUGUUCAA | 206-224 | 204 |
| 94 | NUGAACAUGGAAUCCAUGC | 328 | GCAUGGAUUCCAUGUUCAN | 206-224 | 204 |
| 95 | NUGAACAUGGAAUCCAUGN | 329 | NCAUGGAUUCCAUGUUCAN | 206-224 | 204 |
| 96 | UCAAACUCAUGAACAUGGA | 330 | UCCAUGUUCAUGAGUUUGA | 214-232 | 212 |
| 97 | ACAAACUCAUGAACAUGGA | 331 | UCCAUGUUCAUGAGUUUGU | 214-232 | 212 |
| 98 | CCAAACUCAUGAACAUGGA | 332 | UCCAUGUUCAUGAGUUUGG | 214-232 | 212 |
| 99 | NCAAACUCAUGAACAUGGA | 333 | UCCAUGUUCAUGAGUUUGN | 214-232 | 212 |

TABLE 2-continued

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 100 | NCAAACUCAUGAACAUGGN | 334 | NCCAUGUUCAUGAGUUUGN | 214-232 | 212 |
| 101 | UGAUUAAAGUGAGGACCUG | 335 | CAGGUCCUCACUUUAAUCA | 259-277 | 257 |
| 102 | AGAUUAAAGUGAGGACCUG | 336 | CAGGUCCUCACUUUAAUCU | 259-277 | 257 |
| 103 | GGAUUAAAGUGAGGACCUG | 337 | CAGGUCCUCACUUUAAUCC | 259-277 | 257 |
| 104 | NGAUUAAAGUGAGGACCUG | 338 | CAGGUCCUCACUUUAAUCN | 259-277 | 257 |
| 105 | NGAUUAAAGUGAGGACCUN | 339 | NAGGUCCUCACUUUAAUCN | 259-277 | 257 |
| 106 | UAACAUGCCUCUCUUCAUC | 340 | GAUGAAGAGAGGCAUGUUA | 306-324 | 304 |
| 107 | AAACAUGCCUCUCUUCAUC | 341 | GAUGAAGAGAGGCAUGUUU | 306-324 | 304 |
| 108 | CAACAUGCCUCUCUUCAUC | 342 | GAUGAAGAGAGGCAUGUUG | 306-324 | 304 |
| 109 | NAACAUGCCUCUCUUCAUC | 343 | GAUGAAGAGAGGCAUGUUN | 306-324 | 304 |
| 110 | NAACAUGCCUCUCUUCAUN | 344 | NAUGAAGAGAGGCAUGUUN | 306-324 | 304 |
| 111 | AGAUCACAGAAUCUUCAAU | 345 | AUUGAAGAUUCUGUGAUCU | 375-393 | 373 |
| 112 | UGAUCACAGAAUCUUCAAU | 346 | AUUGAAGAUUCUGUGAUCA | 375-393 | 373 |
| 113 | NGAUCACAGAAUCUUCAAU | 347 | AUUGAAGAUUCUGUGAUCN | 375-393 | 373 |
| 114 | NGAUCACAGAAUCUUCAAN | 348 | NUUGAAGAUUCUGUGAUCN | 375-393 | 373 |
| 115 | UGAGAUCACAGAAUCUUCA | 349 | UGAAGAUUCUGUGAUCUCA | 377-395 | 375 |
| 116 | AGAGAUCACAGAAUCUUCA | 350 | UGAAGAUUCUGUGAUCUCU | 377-395 | 375 |
| 117 | NGAGAUCACAGAAUCUUCA | 351 | UGAAGAUUCUGUGAUCUCN | 377-395 | 375 |
| 118 | NGAGAUCACAGAAUCUUCN | 352 | NGAAGAUUCUGUGAUCUCN | 377-395 | 375 |
| 119 | UCUUUUUCAUGGACCACCA | 353 | UGGUGGUCCAUGAAAAAGA | 430-448 | 428 |
| 120 | ACUUUUUCAUGGACCACCA | 354 | UGGUGGUCCAUGAAAAAGU | 430-448 | 428 |
| 121 | GCUUUUUCAUGGACCACCA | 355 | UGGUGGUCCAUGAAAAAGC | 430-448 | 428 |
| 122 | NCUUUUUCAUGGACCACCA | 356 | UGGUGGUCCAUGAAAAAGN | 430-448 | 428 |
| 123 | NCUUUUUCAUGGACCACCN | 357 | NGGUGGUCCAUGAAAAAGN | 430-448 | 428 |
| 124 | AAGUCAUCUGCUUUUUCAU | 358 | AUGAAAAGCAGAUGACUUU | 439-457 | 437 |
| 125 | UAGUCAUCUGCUUUUUCAU | 359 | AUGAAAAGCAGAUGACUUA | 439-457 | 43" |
| 126 | NAGUCAUCUGCUUUUUCAU | 360 | AUGAAAAGCAGAUGACUUN | 439-457 | 437 |
| 127 | NAGUCAUCUGCUUUUUCAN | 361 | NUGAAAAGCAGAUGACUUN | 439-457 | 437 |
| 128 | UAAGUCAUCUGCUUUUUCA | 362 | UGAAAAGCAGAUGACUUUA | 440-458 | 438 |
| 129 | AAAGUCAUCUGCUUUUUCA | 363 | UGAAAAGCAGAUGACUUUU | 440-458 | 438 |
| 130 | CAAGUCAUCUGCUUUUUCA | 364 | UGAAAAGCAGAUGACUUUG | 440-458 | 438 |
| 131 | NAAGUCAUCUGCUUUUUCA | 365 | UGAAAAGCAGAUGACUUUN | 440-458 | 438 |
| 132 | NAAGUCAUCUGCUUUUUCN | 366 | NGAAAAGCAGAUGACUUUN | 440-458 | 438 |
| 133 | UUACUUUCUUCAUUUCCAC | 367 | GUGGAAAUGAAGAAAGUAA | 466-484 | 464 |
| 134 | AUACUUUCUUCAUUUCCAC | 368 | GUGGAAAUGAAGAAAGUAU | 466-484 | 464 |

TABLE 2-continued

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 135 | GUACUUUCUUCAUUUCCAC | 369 | GUGGAAAUGAAGAAAGUAC | 466-484 | 464 |
| 136 | NUACUUUCUUCAUUUCCAC | 370 | GUGGAAAUGAAGAAAGUAN | 466-484 | 464 |
| 137 | NUACUUUCUUCAUUUCCAN | 371 | NUGGAAAUGAAGAAAGUAN | 466-484 | 464 |
| 138 | UCCAAUUACACCACAAGCC | 372 | GGCUUGUGGUGUAAUUGGA | 512-530 | 510 |
| 139 | ACCAAUUACACCACAAGCC | 373 | GGCUUGUGGUGUAAUUGGU | 512-530 | 510 |
| 140 | CCCAAUUACACCACAAGCC | 374 | GGCUUGUGGUGUAAUUGGG | 512-530 | 510 |
| 141 | NCCAAUUACACCACAAGCC | 375 | GGCUUGUGGUGUAAUUGGN | 512-530 | 510 |
| 142 | NCCAAUUACACCACAAGCN | 376 | NGCUUGUGGUGUAAUUGGN | 512-530 | 510 |
| 143 | UUACAUCCAAGGGAAUGUU | 377 | AACAUUCCCUUGGAUGUAA | 542-560 | 540 |
| 144 | AUACAUCCAAGGGAAUGUU | 378 | AACAUUCCCUUGGAUGUAU | 542-560 | 540 |
| 145 | CUACAUCCAAGGGAAUGUU | 379 | AACAUUCCCUUGGAUGUAG | 542-560 | 540 |
| 146 | NUACAUCCAAGGGAAUGUU | 380 | AACAUUCCCUUGGAUGUAN | 542-560 | 540 |
| 147 | NUACAUCCAAGGGAAUGUN | 381 | NACAUUCCCUUGGAUGUAN | 542-560 | 540 |
| 148 | UAGACUACAUCCAAGGGAA | 382 | UUCCCUUGGAUGUAGUCUA | 546-564 | 544 |
| 149 | AAGACUACAUCCAAGGGAA | 383 | UUCCCUUGGAUGUAGUCUU | 546-564 | 544 |
| 150 | CAGACUACAUCCAAGGGAA | 384 | UUCCCUUGGAUGUAGUCUG | 546-564 | 544 |
| 151 | NAGACUACAUCCAAGGGAA | 385 | UUCCCUUGGAUGUAGUCUN | 546-564 | 544 |
| 152 | NAGACUACAUCCAAGGGAN | 386 | NUCCCUUGGAUGUAGUCUN | 546-564 | 544 |
| 153 | UGAUAACAGAUGAGUUAAG | 387 | CUUAACUCAUCUGUUAUCA | 571-589 | 569 |
| 154 | AGAUAACAGAUGAGUUAAG | 388 | CUUAACUCAUCUGUUAUCU | 571-589 | 569 |
| 155 | GGAUAACAGAUGAGUUAAG | 389 | CUUAACUCAUCUGUUAUCC | 571-589 | 569 |
| 156 | NGAUAACAGAUGAGUUAAG | 390 | CUUAACUCAUCUGUUAUCN | 571-589 | 569 |
| 157 | NGAUAACAGAUGAGUUAAN | 391 | NUUAACUCAUCUGUUAUCN | 571-589 | 569 |
| 158 | AGGAUAACAGAUGAGUUAA | 392 | UUAACUCAUCUGUUAUCCU | 572-590 | 570 |
| 159 | UGGAUAACAGAUGAGUUAA | 393 | UUAACUCAUCUGUUAUCCA | 572-590 | 570 |
| 160 | NGGAUAACAGAUGAGUUAA | 394 | UUAACUCAUCUGUUAUCCN | 572-590 | 570 |
| 161 | NGGAUAACAGAUGAGUUAN | 395 | NUAACUCAUCUGUUAUCCN | 572-590 | 570 |
| 162 | UAGGAUAACAGAUGAGUUA | 396 | UAACUCAUCUGUUAUCCUA | 573-591 | 571 |
| 163 | AAGGAUAACAGAUGAGUUA | 397 | UAACUCAUCUGUUAUCCUU | 573-591 | 571 |
| 164 | CAGGAUAACAGAUGAGUUA | 398 | UAACUCAUCUGUUAUCCUG | 573-591 | 571 |
| 165 | NAGGAUAACAGAUGAGUUA | 399 | UAACUCAUCUGUUAUCCUN | 573-591 | 571 |
| 166 | NAGGAUAACAGAUGAGUUN | 400 | NAACUCAUCUGUUAUCCUN | 573-591 | 571 |
| 167 | UCAGGAUAACAGAUGAGUU | 401 | AACUCAUCUGUUAUCCUGA | 574-592 | 572 |
| 168 | ACAGGAUAACAGAUGAGUU | 402 | AACUCAUCUGUUAUCCUGU | 574-592 | 572 |
| 169 | GCAGGAUAACAGAUGAGUU | 403 | AACUCAUCUGUUAUCCUGC | 574-592 | 572 |

TABLE 2-continued

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 170 | NCAGGAUAACAGAUGAGUU | 404 | AACUCAUCUGUUAUCCUGN | 574-592 | 572 |
| 171 | NCAGGAUAACAGAUGAGUN | 405 | NACUCAUCUGUUAUCCUGN | 574-592 | 572 |
| 172 | UCUAGCAGGAUAACAGAUG | 406 | CAUCUGUUAUCCUGCUAGA | 578-596 | 576 |
| 173 | ACUAGCAGGAUAACAGAUG | 407 | CAUCUGUUAUCCUGCUAGU | 578-596 | 576 |
| 174 | GCUAGCAGGAUAACAGAUG | 408 | CAUCUGUUAUCCUGCUAGC | 578-596 | 576 |
| 175 | NCUAGCAGGAUAACAGAUG | 409 | CAUCUGUUAUCCUGCUAGN | 578-596 | 576 |
| 176 | NCUAGCAGGAUAACAGAUN | 410 | NAUCUGUUAUCCUGCUAGN | 578-596 | 576 |
| 177 | UAGCUAGCAGGAUAACAGA | 411 | UCUGUUAUCCUGCUAGCUA | 580-598 | 578 |
| 178 | AAGCUAGCAGGAUAACAGA | 412 | UCUGUUAUCCUGCUAGCUU | 580-598 | 578 |
| 179 | CAGCUAGCAGGAUAACAGA | 413 | UCUGUUAUCCUGCUAGCUG | 580-598 | 578 |
| 180 | NAGCUAGCAGGAUAACAGA | 414 | UCUGUUAUCCUGCUAGCUN | 580-598 | 578 |
| 181 | NAGCUAGCAGGAUAACAGN | 415 | NCUGUUAUCCUGCUAGCUN | 580-598 | 578 |
| 182 | UUCUACAGCUAGCAGGAUA | 416 | UAUCCUGCUAGCUGUAGAA | 585-603 | 583 |
| 183 | AUCUACAGCUAGCAGGAUA | 417 | UAUCCUGCUAGCUGUAGAU | 585-603 | 583 |
| 184 | NUCUACAGCUAGCAGGAUA | 418 | UAUCCUGCUAGCUGUAGAN | 585-603 | 583 |
| 185 | NUCUACAGCUAGCAGGAUN | 419 | NAUCCUGCUAGCUGUAGAN | 585-603 | 583 |
| 186 | UAUUUCUACAGCUAGCAGG | 420 | CCUGCUAGCUGUAGAAAUA | 588-606 | 586 |
| 187 | AAUUUCUACAGCUAGCAGG | 421 | CCUGCUAGCUGUAGAAAUU | 588-606 | 586 |
| 188 | CAUUUCUACAGCUAGCAGG | 422 | CCUGCUAGCUGUAGAAAUG | 588-606 | 586 |
| 189 | NAUUUCUACAGCUAGCAGG | 423 | CCUGCUAGCUGUAGAAAUN | 588-606 | 586 |
| 190 | NAUUUCUACAGCUAGCAGN | 424 | NCUGCUAGCUGUAGAAAUN | 588-606 | 586 |
| 191 | UACAUUUCUACAGCUAGCA | 425 | UGCUAGCUGUAGAAAUGUA | 590-608 | 588 |
| 192 | AACAUUUCUACAGCUAGCA | 426 | UGCUAGCUGUAGAAAUGUU | 590-608 | 588 |
| 193 | NACAUUUCUACAGCUAGCA | 427 | UGCUAGCUGUAGAAAUGUN | 590-608 | 588 |
| 194 | NACAUUUCUACAGCUAGCN | 428 | NGCUAGCUGUAGAAAUGUN | 590-608 | 588 |
| 195 | AUACAUUUCUACAGCUAGC | 429 | GCUAGCUGUAGAAAUGUAU | 591-609 | 589 |
| 196 | UUACAUUUCUACAGCUAGC | 430 | GCUAGCUGUAGAAAUGUAA | 591-609 | 589 |
| 197 | NUACAUUUCUACAGCUAGC | 43. | GCUAGCUGUAGAAAUGUAN | 591-609 | 589 |
| 198 | NUACAUUUCUACAGCUAGN | 432 | NCUAGCUGUAGAAAUGUAN | 591-609 | 589 |
| 199 | UGAUACAUUUCUACAGCUA | 433 | UAGCUGUAGAAAUGUAUCA | 593-611 | 591 |
| 200 | AGAUACAUUUCUACAGCUA | 434 | UAGCUGUAGAAAUGUAUCU | 593-611 | 591 |
| 201 | GGAUACAUUUCUACAGCUA | 435 | UAGCUGUAGAAAUGUAUCC | 593-611 | 591 |
| 202 | NGAUACAUUUCUACAGCUA | 436 | UAGCUGUAGAAAUGUAUCN | 593-611 | 591 |
| 203 | NGAUACAUUUCUACAGCUN | 437 | NAGCUGUAGAAAUGUAUCN | 593-611 | 591 |
| 204 | UAGGAUACAUUUCUACAGC | 438 | GCUGUAGAAAUGUAUCCUA | 595-613 | 593 |

TABLE 2-continued

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 205 | AAGGAUACAUUUCUACAGC | 439 | GCUGUAGAAAUGUAUCCUU | 595-613 | 593 |
| 206 | CAGGAUACAUUUCUACAGC | 440 | GCUGUAGAAAUGUAUCCUG | 595-613 | 593 |
| 207 | NAGGAUACAUUUCUACAGC | 441 | GCUGUAGAAAUGUAUCCUN | 595-613 | 593 |
| 208 | NAGGAUACAUUUCUACAGN | 442 | NCUGUAGAAAUGUAUCCUN | 595-613 | 593 |
| 209 | UCAGGAUACAUUUCUACAG | 443 | CUGUAGAAAUGUAUCCUGA | 596-614 | 594 |
| 210 | ACAGGAUACAUUUCUACAG | 444 | CUGUAGAAAUGUAUCCUGU | 596-614 | 594 |
| 211 | NCAGGAUACAUUUCUACAG | 445 | CUGUAGAAAUGUAUCCUGN | 596-614 | 594 |
| 212 | NCAGGAUACAUUUCUACAN | 446 | NUGUAGAAAUGUAUCCUGN | 596-614 | 594 |
| 213 | AUGUUUAUCAGGAUACAUU | 447 | AAUGUAUCCUGAUAAACAU | 603-621 | 601 |
| 214 | UUGUUUAUCAGGAUACAUU | 448 | AAUGUAUCCUGAUAAACAA | 603-621 | 601 |
| 215 | NUGUUUAUCAGGAUACAUU | 449 | AAUGUAUCCUGAUAAACAN | 603-621 | 601 |
| 216 | NUGUUUAUCAGGAUACAUN | 450 | NAUGUAUCCUGAUAAACAN | 603-621 | 601 |
| 217 | AGUGUUUAAUGUUUAUCAG | 45 | CUGAUAAACAUUAAACACU | 611-629 | 609 |
| 218 | UGUGUUUAAUGUUUAUCAG | 452 | CUGAUAAACAUUAAACACA | 611-629 | 609 |
| 219 | NGUGUUUAAUGUUUAUCAG | 453 | CUGAUAAACAUUAAACACN | 611-629 | 609 |
| 220 | NGUGUUUAAUGUUUAUCAN | 454 | NUGAUAAACAUUAAACACN | 611-629 | 609 |
| 221 | AGAUUACAGUGUUUAAUGU | 455 | ACAUUAAACACUGUAAUCU | 618-636 | 616 |
| 222 | UGAUUACAGUGUUUAAUGU | 456 | ACAUUAAACACUGUAAUCA | 618-636 | 616 |
| 223 | NGAUUACAGUGUUUAAUGU | 457 | ACAUUAAACACUGUAAUCN | 618-636 | 616 |
| 224 | NGAUUACAGUGUUUAAUGN | 458 | NCAUUAAACACUGUAAUCN | 618-636 | 616 |
| 225 | UAAGAUUACAGUGUUUAAU | 459 | AUUAAACACUGUAAUCUUA | 620-638 | 618 |
| 226 | AAAGAUUACAGUGUUUAAU | 460 | AUUAAACACUGUAAUCUUU | 620-638 | 618 |
| 227 | NAAGAUUACAGUGUUUAAU | 461 | AUUAAACACUGUAAUCUUN | 620-638 | 618 |
| 228 | NAAGAUUACAGUGUUUAAN | 462 | NUUAAACACUGUAAUCUUN | 620-638 | 618 |
| 229 | UACUACAGGUACUUUAAAG | 463 | CUUUAAAGUACCUGUAGUA | 670-688 | 668 |
| 230 | AACUACAGGUACUUUAAAG | 464 | CUUUAAAGUACCUGUAGUU | 670-688 | 668 |
| 231 | CACUACAGGUACUUUAAAG | 465 | CUUUAAAGUACCUGUAGUG | 670-688 | 668 |
| 232 | NACUACAGGUACUUUAAAG | 466 | CUUUAAAGUACCUGUAGUN | 670-688 | 668 |
| 233 | NACUACAGGUACUUUAAAN | 467 | NUUUAAAGUACCUGUAGUN | 670-688 | 668 |
| 234 | UAAGUGAUCAUAAAUCAGU | 468 | ACUGAUUUAUGAUCACUUA | 693-711 | 691 |
| 235 | AAAGUGAUCAUAAAUCAGU | 469 | ACUGAUUUAUGAUCACUUU | 693-711 | 691 |
| 236 | CAAGUGAUCAUAAAUCAGU | 470 | ACUGAUUUAUGAUCACUUG | 693-711 | 691 |
| 237 | NAAGUGAUCAUAAAUCAGU | 471 | ACUGAUUUAUGAUCACUUN | 693-711 | 691 |
| 238 | NAAGUGAUCAUAAAUCAGN | 472 | NCUGAUUUAUGAUCACUUN | 693-711 | 691 |
| 239 | AAAUCUUCCAAGUGAUCAU | 473 | AUGAUCACUUGGAAGAUUU | 701-719 | 699 |

TABLE 2-continued

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 240 | UAAUCUUCCAAGUGAUCAU | 474 | AUGAUCACUUGGAAGAUUA | 701-719 | 699 |
| 241 | NAAUCUUCCAAGUGAUCAU | 475 | AUGAUCACUUGGAAGAUUN | 701-719 | 699 |
| 242 | NAAUCUUCCAAGUGAUCAN | 476 | NUGAUCACUUGGAAGAUUN | 701-719 | 699 |
| 243 | UACAAAUCUUCCAAGUGAU | 477 | AUCACUUGGAAGAUUUGUA | 704-722 | 702 |
| 244 | AACAAAUCUUCCAAGUGAU | 478 | AUCACUUGGAAGAUUUGUU | 704-722 | 702 |
| 245 | NACAAAUCUUCCAAGUGAU | 479 | AUCACUUGGAAGAUUUGUN | 704-722 | 702 |
| 246 | NACAAAUCUUCCAAGUGAN | 480 | NUCACUUGGAAGAUUUGUN | 704-722 | 702 |
| 247 | AAACUAUACAAAUCUUCCA | 481 | UGGAAGAUUUGUAUAGUUU | 710-728 | 708 |
| 248 | UAACUAUACAAAUCUUCCA | 482 | UGGAAGAUUUGUAUAGUUA | 710-728 | 708 |
| 249 | NAACUAUACAAAUCUUCCA | 483 | UGGAAGAUUUGUAUAGUUN | 710-728 | 708 |
| 250 | NAACUAUACAAAUCUUCCN | 484 | NGGAAGAUUUGUAUAGUUN | 710-728 | 708 |
| 251 | UUGAAACAGACAUUUUAAC | 485 | GUUAAAAUGUCUGUUUCAA | 740-758 | 738 |
| 252 | AUGAAACAGACAUUUUAAC | 486 | GUUAAAAUGUCUGUUUCAU | 740-758 | 738 |
| 253 | NUGAAACAGACAUUUUAAC | 487 | GUUAAAAUGUCUGUUUCAN | 740-758 | 738 |
| 254 | NUGAAACAGACAUUUUAAN | 488 | NUUAAAAUGUCUGUUUCAN | 740-758 | 738 |
| 255 | AGGUCAUUGAAACAGACAU | 489 | AUGUCUGUUUCAAUGACCU | 746-764 | 744 |
| 256 | UGGUCAUUGAAACAGACAU | 490 | AUGUCUGUUUCAAUGACCA | 746-764 | 744 |
| 257 | NGGUCAUUGAAACAGACAU | 491 | AUGUCUGUUUCAAUGACCN | 746-764 | 744 |
| 258 | NGGUCAUUGAAACAGACAN | 492 | NUGUCUGUUUCAAUGACCN | 746-764 | 744 |
| 259 | AAAUACAGGUCAUUGAAAC | 493 | GUUUCAAUGACCUGUAUUU | 752-770 | 750 |
| 260 | UAAUACAGGUCAUUGAAAC | 494 | GUUUCAAUGACCUGUAUUA | 752-770 | 750 |
| 261 | NAAUACAGGUCAUUGAAAC | 495 | GUUUCAAUGACCUGUAUUN | 752-770 | 750 |
| 262 | NAAUACAGGUCAUUGAAAN | 496 | NUUUCAAUGACCUGUAUUN | 752-770 | 750 |
| 263 | AAGUCUGGCAAAAUACAGG | 497 | CCUGUAUUUUGCCAGACUU | 762-780 | 760 |
| 264 | UAGUCUGGCAAAAUACAGG | 498 | CCUGUAUUUUGCCAGACUA | 762-780 | 760 |
| 265 | NAGUCUGGCAAAAUACAGG | 499 | CCUGUAUUUUGCCAGACUN | 762-780 | 760 |
| 266 | NAGUCUGGCAAAAUACAGN | 500 | NCUGUAUUUUGCCAGACUN | 762-780 | 760 |
| 267 | UAAUACCCAUCUGUGAUUU | 501 | AAAUCACAGAUGGGUAUUA | 781-799 | 779 |
| 268 | AAAUACCCAUCUGUGAUUU | 502 | AAAUCACAGAUGGGUAUUU | 781-799 | 779 |
| 269 | NAAUACCCAUCUGUGAUUU | 503 | AAAUCACAGAUGGGUAUUN | 781-799 | 779 |
| 270 | NAAUACCCAUCUGUGAUUN | 504 | NAAUCACAGAUGGGUAUUN | 781-799 | 779 |
| 271 | AAGUUUAAUACCCAUCUGU | 505 | ACAGAUGGGUAUUAAACUU | 786-804 | 784 |
| 272 | UAGUUUAAUACCCAUCUGU | 506 | ACAGAUGGGUAUUAAACUA | 786-804 | 784 |
| 273 | NAGUUUAAUACCCAUCUGU | 507 | ACAGAUGGGUAUUAAACUN | 786-804 | 784 |
| 274 | NAGUUUAAUACCCAUCUGN | 508 | NCAGAUGGGUAUUAAACUN | 786-804 | 784 |

TABLE 2-continued

SOD1 RNAi Agent Antisense Strand and Sense Strand Core Stretch Base Sequences
(N = any nucleobase; I = inosine(hypoxanthine nucleobase)

| SEQ ID NO:. | Antisense Strand Base Sequence (5' → 3') (Shown as an Unmodified Nucleotide Sequence) | SEQ ID NO:. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 275 | UAAGUUUAAUACCCAUCUG | 509 | CAGAUGGGUAUUAAACUUA | 787-805 | 785 |
| 276 | AAAGUUUAAUACCCAUCUG | 510 | CAGAUGGGUAUUAAACUUU | 787-805 | 785 |
| 277 | CAAGUUUAAUACCCAUCUG | 511 | CAGAUGGGUAUUAAACUUG | 787-805 | 785 |
| 278 | NAAGUUUAAUACCCAUCUG | 512 | CAGAUGGGUAUUAAACUUN | 787-805 | 785 |
| 278 | NAAGUUUAAUACCCAUCUN | 513 | NAGAUGGGUAUUAAACUUN | 787-805 | 785 |
| 280 | ACAAGUUUAAUACCCAUCU | 514 | AGAUGGGUAUUAAACUUGU | 788-806 | 786 |
| 281 | UCAAGUUUAAUACCCAUCU | 515 | AGAUGGGUAUUAAACUUGA | 788-806 | 786 |
| 282 | NCAAGUUUAAUACCCAUCU | 516 | AGAUGGGUAUUAAACUUGN | 788-806 | 786 |
| 283 | NCAAGUUUAAUACCCAUCN | 517 | NGAUGGGUAUUAAACUUGN | 788-806 | 786 |
| 284 | UGACAAGUUUAAUACCCAU | 518 | AUGGGUAUUAAACUUGUCA | 790-808 | 788 |
| 285 | AGACAAGUUUAAUACCCAU | 519 | AUGGGUAUUAAACUUGUCU | 790-808 | 788 |
| 286 | NGACAAGUUUAAUACCCAU | 520 | AUGGGUAUUAAACUUGUCN | 790-808 | 788 |
| 287 | NGACAAGUUUAAUACCCAN | 521 | NUGGGUAUUAAACUUGUCN | 790-808 | 788 |

The SOD1 RNAi agent sense strands and antisense strands that comprise or consist of the nucleotide sequences in Table 2 can be modified nucleotides or unmodified nucleotides. In some embodiments, the SOD1 RNAi agents having the sense and antisense strand sequences that comprise or consist of any of the nucleotide sequences in Table 2 are all or substantially all modified nucleotides.

In some embodiments, the antisense strand of a SOD1 RNAi agent disclosed herein differs by 0, 1, 2, or 3 nucleotides from any of the antisense strand sequences in Table 2. In some embodiments, the sense strand of a SOD1 RNAi agent disclosed herein differs by 0, 1, 2, or 3 nucleotides from any of the sense strand sequences in Table 2.

As used herein, each N listed in a sequence disclosed in Table 2 may be independently selected from any and all nucleobases (including those found on both modified and unmodified nucleotides). In some embodiments, an N nucleotide listed in a sequence disclosed in Table 2 has a nucleobase that is complementary to the N nucleotide at the corresponding position on the other strand. In some embodiments, an N nucleotide listed in a sequence disclosed in Table 2 has a nucleobase that is not complementary to the N nucleotide at the corresponding position on the other strand. In some embodiments, an N nucleotide listed in a sequence disclosed in Table 2 has a nucleobase that is the same as the N nucleotide at the corresponding position on the other strand. In some embodiments, an N nucleotide listed in a sequence disclosed in Table 2 has a nucleobase that is different from the N nucleotide at the corresponding position on the other strand.

Certain modified SOD1 RNAi agent sense and antisense strands are provided in Table 3, Table 4, Table 5, Table 6, Table 6a, and Table 10. Certain modified SOD1 RNAi agent antisense strands, as well as their underlying unmodified nucleobase sequences, are provided in Table 3. Certain modified SOD1 RNAi agent sense strands, as well as their underlying unmodified nucleobase sequences, are provided in Tables 4, 5, and 6. In forming SOD1 RNAi agents, each of the nucleotides in each of the underlying base sequences listed in Tables 3, 4, 5, and 6, as well as in Table 2, above, can be a modified nucleotide.

The SOD1 RNAi agents described herein are formed by annealing an antisense strand with a sense strand. A sense strand containing a sequence listed in Table 2, Table 4, Table 5, Table 6, Table 6a can be hybridized to any antisense strand containing a sequence listed in Table 2 or Table 3, provided the two sequences have a region of at least 85% complementarity over a contiguous 16, 17, 18, 19, 20, or 21 nucleotide sequence.

In some embodiments, a SOD1 RNAi agent antisense strand comprises a nucleotide sequence of any of the sequences in Table 2 or Table 3.

In some embodiments, a SOD1 RNAi agent comprises or consists of a duplex having the nucleobase sequences of the sense strand and the antisense strand of any of the sequences in Table 2, Table 3, Table 4, Table 5, Table 6, Table 6a, or Table 10.

Examples of antisense strands containing modified nucleotides are provided in Table 3. Examples of sense strands containing modified nucleotides are provided in Tables 4, 5 and 6.

As used in Tables 3, 4, 5, 6, and 10, the following notations are used to indicate modified nucleotides, targeting groups, and linking groups:

A=adenosine-3'-phosphate
C=cytidine-3'-phosphate
G=guanosine-3'-phosphate
U=uridine-3'-phosphate
I=inosine-3'-phosphate
a=2'-O-methyladenosine-3'-phosphate
as=2'-O-methyladenosine-3'-phosphorothioate
c=2'-O-methylcytidine-3'-phosphate
cs=2'-O-methylcytidine-3'-phosphorothioate
g=2'-O-methylguanosine-3'-phosphate gs=2'-O-methylguanosine-3'-phosphorothioate
i=2'-O-methylinosine-3'-phosphate
is=2'-O-methylinosine-3'-phosphorothioate
t=2'-O-methyl-5-methyluridine-3'-phosphate
ts=2'-O-methyl-5-methyluridine-3'-phosphorothioate
u=2'-O-methyluridine-3'-phosphate
us=2'-O-methyluridine-3'-phosphorothioate
Af=2'-fluoroadenosine-3'-phosphate
Afs=2'-fluoroadenosine-3'-phosporothioate
Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
dT=2'-deoxythymidine-3'-phosphate
$A_{UNA}$=2',3'-seco-adenosine-3'-phosphate
$A_{UNAS}$=2',3'-seco-adenosine-3'-phosphorothioate
$C_{UNA}$=2',3'-seco-cytidine-3'-phosphate
$C_{UNAS}$=2',3'-seco-cytidine-3'-phosphorothioate
$G_{UNA}$=2',3'-seco-guanosine-3'-phosphate
$G_{UNAS}$=2',3'-seco-guanosine-3'-phosphorothioate
$U_{UNA}$=2',3'-seco-uridine-3'-phosphate
$U_{UNAS}$=2',3'-seco-uridine-3'-phosphorothioate
a_2N=see Table 11
a_2Ns=see Table 11
(invAb)=inverted abasic deoxyribonucleotide-5'-phosphate, see Table 11
(invAb)s=inverted abasic deoxyribonucleotide-5'-phosphorothioate, see Table 11
s=phosphorothioate linkage
p=terminal phosphate (as synthesized)
vpdN=vinyl phosphonate deoxyribonucleotide
cPrpa=5'-cyclopropyl phosphonate-2'-O-methyladenosine-3'-phosphate (see Table 11)
cPrpas=5'-cyclopropyl phosphonate-2'-O-methyladenosine-3'-phosphorothioate (see Table 11)
cPrpu=5'-cyclopropyl phosphonate-2'-O-methyluridine-3'-phosphate (see Table 11)
cPrpus=5'-cyclopropyl phosphonate-2'-O-methyluridine-3'-phosphorothioate (see Table 11)
(Alk-SS—C6)=see Table 11
(C6-SS-Alk)=see Table 11
(C6-SS—C6)=see Table 11
(6-SS-6)=see Table 11
(C6-SS-Alk-Me)=see Table 11
(NH2-C6)=see Table 11
(NH—C6)=see Table 11
(NH—C6)s=see Table 11
-L6-C6— =see Table 11
-L6-C6s-=see Table 11
LP183rs=see Table 11
LP409s=see Table 11
cC16=see Table 11
aC16=see Table 11
gC16=see Table 11
uC16=see Table 11
ALNA=see Table 11
c16s=see Table 11
C22s=see Table 11
HO—C16s=see Table 11
(2C8C12)s=see Table 11
(2C6C10)s=see Table 11
LP283=see Table 11
LP293=see Table 11
LP310=see Table 11
LP383=see Table 11
LP395=see Table 11
LP395s=see Table 11
LP396=see Table 11

As the person of ordinary skill in the art would readily understand, unless otherwise indicated by the sequence (such as, for example, by a phosphorothioate linkage "s"), when present in an oligonucleotide, the nucleotide monomers are mutually linked by 5'-3'-phosphodiester bonds. As the person of ordinary skill in the art would clearly understand, the inclusion of a phosphorothioate linkage as shown in the modified nucleotide sequences disclosed herein replaces the phosphodiester linkage typically present in oligonucleotides. Further, the person of ordinary skill in the art would readily understand that the terminal nucleotide at the 3' end of a given oligonucleotide sequence would typically have a hydroxyl (—OH) group at the respective 3' position of the given monomer instead of a phosphate moiety ex vivo. Additionally, for the embodiments disclosed herein, when viewing the respective strand 5'→3', the inverted abasic residues are inserted such that the 3' position of the deoxyribose is linked at the 3' end of the preceding monomer on the respective strand (see, e.g., Table 11). Moreover, as the person of ordinary skill would readily understand and appreciate, while the phosphorothioate chemical structures depicted herein typically show the anion on the sulfur atom, the inventions disclosed herein encompass all phosphorothioate tautomers (e.g., where the sulfur atom has a double-bond and the anion is on an oxygen atom). Unless expressly indicated otherwise herein, such understandings of the person of ordinary skill in the art are used when describing the SOD1 RNAi agents and compositions of SOD1 RNAi agents disclosed herein.

Certain examples of PK/PD modulators and linking groups used with the SOD1 RNAi agents disclosed herein are included in the chemical structures provided below in Table 11. Each sense strand and/or antisense strand can have any PK/PD modulators or linking groups listed herein, as well as other targeting groups, PK/PD modulators, linking groups, conjugated to the 5' and/or 3' end of the sequence.

TABLE 3

SOD1 RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| AM13284-AS | usUfsusCfaCfugguCfaUfuAfcUfuusc | 522 | UUUCACUGGUCCAUUACUUUC | 1080 |
| AM13286-AS | usAfsasCfaUfggaauCfcAfuGfcAfggsc | 523 | UAACAUGGAAUCCAUGCAGGC | 1081 |
| AM13288-AS | usCfsasAfaCfucaugAfaCfaUfgGfaasu | 524 | UCAAACUCAUGAACAUGGAAU | 1082 |

TABLE 3-continued

SOD1 RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| AM13290-AS | usGfsasUfuAfaagugAfgGfaCfcUfgcsa | 525 | UGAUUAAAGUGAGGACCUGCA | 1083 |
| AM13292-AS | usGfsasUfaGfaggauUfaAfaGfuGfagsg | 526 | UGAUAGAGGAUUAAAGUGAGG | 1084 |
| AM13294-AS | usAfsasCfaUfgccucUfcUfuCfaUfccsu | 527 | UAACAUGCCUCUCUUCAUCCU | 1085 |
| AM13296-AS | asGfsasUfcAfcagaaUfcUfuCfaAfuasg | 528 | AGAUCACAGAAUCUUCAAUAG | 1086 |
| AM13298-AS | usCfscsAfaUfuacacCfaCfaAfgCfcasa | 529 | UCCAAUUACACCACAAGCCAA | 1087 |
| AM13300-AS | usUfsasCfaUfccaagGfgAfaUfgUfuusa | 530 | UUACAUCCAAGGGAAUGUUUA | 1088 |
| AM13302-AS | usAfsgsAfcUfacaucCfaAfgGfgAfausg | 531 | UAGACUACAUCCAAGGGAAUG | 1089 |
| AM13304-AS | usAfsgsGfaUfaacagAfuGfaGfuUfaasg | 532 | UAGGAUAACAGAUGAGUUAAG | 1090 |
| AM13306-AS | usUfscsUfaCfagcuaGfcAfgGfaUfaasc | 533 | UUCUACAGCUAGCAGGAUAAC | 1091 |
| AM13308-AS | usGfsasUfaCfauuucUfaCfaGfcUfagsc | 534 | UGAUACAUUUCUACAGCUAGC | 1092 |
| AM13310-AS | usAfsgsGfaUfacauuUfcUfaCfaGfcusa | 535 | UAGGAUACAUUUCUACAGCUA | 1093 |
| AM13312-AS | asUfsgsUfuUfaucagGfaUfaCfaUfuusc | 536 | AUGUUUAUCAGGAUACAUUUC | 1094 |
| AM13314-AS | asGfsusGfuUfuaaugUfuUfaUfcAfggsa | 537 | AGUGUUUAAUGUUUAUCAGGA | 1095 |
| AM13316-AS | asGfsasUfuAfcagugUfuUfaAfuGfuusu | 538 | AGAUUACAGUGUUUAAUGUUU | 1096 |
| AM13318-AS | usAfscsUfaCfagguaCfuUfuAfaAfgcsa | 539 | UACUACAGGUACUUUAAAGCA | 1097 |
| AM13320-AS | usAfsasGfuGfaucauAfaAfuCfaGfuusu | 540 | UAAGUGAUCAUAAAUCAGUUU | 1098 |
| AM13322-AS | asAfsasCfuAfuacaaAfuCfuUfcCfaasg | 541 | AAACUAUACAAAUCUUCCAAG | 1099 |
| AM13324-AS | asAfsasUfaCfagguсAfuUfgAfaAfcasg | 542 | AAAUACAGGUCAUUGAAACAG | 1100 |
| AM13326-AS | usAfsasUfaCfccaucUfgUfgAfuUfuasa | 543 | UAAUACCCAUCUGUGAUUUAA | 1101 |
| AM13328-AS | usGfsasCfaAfguuuaAfuAfcCfcAfucsu | 544 | UGACAAGUUUAAUACCCAUCU | 1102 |
| AM13918-AS | usCfsasUfuAfcuuucCfuUfcUfgCfucsg | 545 | UCAUUACUUUCCUUCUGCUCG | 1103 |
| AM13920-AS | usGfsasAfcAfuggaaUfcCfaUfgCfagsg | 546 | UGAACAUGGAAUCCAUGCAGG | 1104 |
| AM13922-AS | usGfsasGfaUfcacagAfaUfcUfuCfaasc | 547 | UGAGAUCACAGAAUCUUCAAC | 1105 |
| AM13924-AS | asAfsasGfuCfaucugCfuUfuUfuCfausg | 548 | AAAGUCAUCUGCUUUUUCAUG | 1106 |
| AM13926-AS | asAfsusUfcCfuacagCfuAfgCfaGfgasu | 549 | AAUUCUACAGCUAGCAGGAU | 1107 |
| AM13928-AS | asAfscsAfaAfucuucCfaAfgUfgAfucsa | 550 | AACAAAUCUUCCAAGUGAUCA | 1108 |
| AM13930-AS | asAfsgsUfuUfaauacCfcAfuCfuGfugsa | 551 | AAGUUUAAUACCCAUCUGUGA | 1109 |
| AM14017-AS | usGfsasuaGfaggauUfaAfaGfugagsg | 552 | UGAUAGAGGAUUAAAGUGAGG | 1084 |
| AM14019-AS | usGfsasuaGfaggauUfaAfaGfugagsc | 553 | UGAUAGAGGAUUAAAGUGAGC | 1110 |
| AM14020-AS | usGfsasuaGfaggauUfaAfaGfugagssc | 554 | UGAUAGAGGAUUAAAGUGAGC | 1110 |
| AM14021-AS | usGfsasuaGfaggAfuUfaAfaGfugagsg | 555 | UGAUAGAGGAUUAAAGUGAGG | 1084 |
| AM14022-AS | usGfsasuagaggAfuUfaAfaGfugagsg | 556 | UGAUAGAGGAUUAAAGUGAGG | 1084 |
| AM14023-AS | usGfsasuagaggauUfaAfaGfugagsg | 557 | UGAUAGAGGAUUAAAGUGAGG | 1084 |
| AM14024-AS | cPrpuGfauaGfaggauUfaAfaGfugagssg | 558 | UGAUAGAGGAUUAAAGUGAGG | 1084 |
| AM14026-AS | usGfsasuaGfaggAfuUfaAfaGfuga | 559 | UGAUAGAGGAUUAAAGUGA | 1111 |
| AM14096-AS | usAfsgsgaUfaacagAfuGfaGfuUfuaasg | 560 | UAGGAUAACAGAUGAGUUAAG | 1090 |

TABLE 3-continued

SOD1 RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| AM14097-AS | usAfsgsgauaacagAfuGfaGfuuaasg | 561 | UAGGAUAACAGAUGAGUUAAG | 1090 |
| AM14098-AS | usAfsgsgauaAfCfagAfuGfaGfuuaasg | 562 | UAGGAUAACAGAUGAGUUAAG | 1090 |
| AM14099-AS | usAfsgsgaUfaacagAfuGfaGfuuaa2Nsg | 563 | UAGGAUAACAGAUGAGUUA($A^{2N}$)G | 1214 |
| AM14100-AS | usAfsgsgaUfaacagAfuGfaGfuua2Nasg | 564 | UAGGAUAACAGAUGAGUU($A^{2N}$)AG | 1215 |
| AM14102-AS | usAfsgsgaUfaacagAfuGfaGfuuagsg | 565 | UAGGAUAACAGAUGAGUUAGG | 1112 |
| AM14103-AS | usAfsgsgaUfaacagAfuGfaGfuuaassg | 566 | UAGGAUAACAGAUGAGUUAAG | 1090 |
| AM14104-AS | cPrpuAfggaUfaacagAfuGfaGfuuaassg | 567 | UAGGAUAACAGAUGAGUUAAG | 1090 |
| AM14106-AS | usAfsgsgaUfaacagAfuGfaGfuusa2N | 568 | UAGGAUAACAGAUGAGUU($A^{2N}$) | 1228 |
| AM14270-AS | usGfsasuaGfaggAfuUfaAfaGfugsa | 569 | UGAUAGAGGAUUAAAGUGA | 1111 |
| AM14271-AS | usGfsasuaGfaggAfuUfaAfaGfugssa | 570 | UGAUAGAGGAUUAAAGUGA | 1111 |
| AM14272-AS | cPrpuGfauaGfaggAfuUfaAfaGfugssa | 571 | UGAUAGAGGAUUAAAGUGA | 1111 |
| AM14273-AS | cPrpuGfauAfgaGfGfauUfaAfaGfugssa | 572 | UGAUAGAGGAUUAAAGUGA | 1111 |
| AM14277-AS | cPrpusGfsasUfaGfaggauUfaAfaGfuGfagsg | 573 | UGAUAGAGGAUUAAAGUGAGG | 1084 |
| AM14279-AS | cPrpusAfsgsGfaUfaacagAfuGfaGfuUfaasg | 574 | UAGGAUAACAGAUGAGUUAAG | 1090 |
| AM14335-AS | cPrpusGfsasuagaggAfuUfaAfaGfugagssg | 575 | UGAUAGAGGAUUAAAGUGAGG | 1084 |
| AM14339-AS | usGfsasuagaggAfuUfaAfaGfugagssg | 576 | UGAUAGAGGAUUAAAGUGAGG | 1084 |
| AM14341-AS | cPrpusGfsasuagaggAfuUfaAfaGfugagsg | 577 | UGAUAGAGGAUUAAAGUGAGG | 1084 |
| AM14342-AS | cPrpusGfsasuagAfggAfuUfaAfaGfugagsg | 578 | UGAUAGAGGAUUAAAGUGAGG | 1084 |
| AM14343-AS | cPrpusGfsasuAfgaggAfuUfaAfaGfugagsg | 579 | UGAUAGAGGAUUAAAGUGAGG | 1084 |
| AM14344-AS | cPrpusGfsasUfagaggAfuUfaAfaGfugagsg | 580 | UGAUAGAGGAUUAAAGUGAGG | 1084 |
| AM14345-AS | PrpuGfauagaggAfuUfaAfaGfugagssg | 581 | UGAUAGAGGAUUAAAGUGAGG | 1084 |
| AM14347-AS | cPrpusGfsasuagaggAfuUfaAfaGfugssa | 582 | UGAUAGAGGAUUAAAGUGA | 1111 |
| AM14365-AS | usAfsgsGfauaacagAfuGfaGfuuaasg | 583 | UAGGAUAACAGAUGAGUUAAG | 1090 |
| AM14366-AS | usAfsgsgAfuaacagAfuGfaGfuuaasg | 584 | UAGGAUAACAGAUGAGUUAAG | 1090 |
| AM14367-AS | usAfsgsgauAfacagAfuGfaGfuuaasg | 585 | UAGGAUAACAGAUGAGUUAAG | 1090 |
| AM14368-AS | usAfsgsGfauaacagAfuGfaGfuua2Nasg | 586 | UAGGAUAACAGAUGAGUU($A^{2N}$)AG | 1215 |
| AM14369-AS | usAfsgsGfauaacagAfuGfaGfuuaassg | 587 | UAGGAUAACAGAUGAGUUAAG | 1090 |
| AM14370-AS | cPrpusAfsgsGfauaacagAfuGfaGfuuaassg | 588 | UAGGAUAACAGAUGAGUUAAG | 1090 |
| AM14371-AS | cPrpuAfgGfauaacagAfuGfaGfuuaassg | 589 | UAGGAUAACAGAUGAGUUAAG | 1090 |
| AM14373-AS | cPrpusAfsgsGfauaacagAfuGfaGfuussa | 590 | UAGGAUAACAGAUGAGUUA | 1113 |
| AM14506-AS | usUfsasCfuuucuucAfuUfuCfcAfcCfsu | 591 | UUACUUCUUCAUUUCCACCU | 1114 |
| AM15044-AS | cPrpusGfsasuagAfggAfuUfaAfaGfugagssg | 592 | UGAUAGAGGAUUAAAGUGAGG | 1084 |
| AM15045-AS | cPrpuGfauagAfggAfuUfaAfaGfugagssg | 593 | UGAUAGAGGAUUAAAGUGAGG | 1084 |
| AM15046-AS | cPrpuGfauagAfggAfuUfaAfaGfugagsg | 594 | UGAUAGAGGAUUAAAGUGAGG | 1084 |
| AM15047-AS | cPrpuGfauagAfggAfuUfaAfaGfugagssc | 595 | UGAUAGAGGAUUAAAGUGAGC | 1110 |
| AM15048-AS | cPrpuGfauagaGfgAfuUfaAfaGfugagsg | 596 | UGAUAGAGGAUUAAAGUGAGG | 1084 |
| AM15050-AS | cPrpuGfauagAfgGfauuaAfaGfugagssg | 597 | UGAUAGAGGAUUAAAGUGAGG | 1084 |

TABLE 3-continued

SOD1 RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
| --- | --- | --- | --- | --- |
| AM15052-AS | cPrpuGfauagAfgGfauuaAfaGfugagssc | 598 | UGAUAGAGGAUUAAAGUGAGC | 1110 |
| AM15054-AS | cPrpuAfgGfauaacagAfuGfaGfuuaassc | 599 | UAGGAUAACAGAUGAGUUAAC | 1115 |
| AM15055-AS | cPrpuAfgGfauaacagAfuGfaGfuuaasg | 600 | UAGGAUAACAGAUGAGUUAAG | 1090 |
| AM15056-AS | cPrpuAfgGfauaacagAfuGfaGfuuasasg | 601 | UAGGAUAACAGAUGAGUUAAG | 1090 |
| AM15058-AS | cPrpuAfggAfuaacAfgAfuGfaGfuuaassg | 602 | UAGGAUAACAGAUGAGUUAAG | 1090 |
| AM15059-AS | cPrpuAfggAfuaacAfgAfuGfaGfuuaassc | 603 | UAGGAUAACAGAUGAGUUAAC | 1115 |
| AM15060-AS | cPrpuAfggauaacAfgAfuGfaGfuuaassg | 604 | UAGGAUAACAGAUGAGUUAAG | 1090 |
| AM15061-AS | cPrpuAfggauaacAfgAfuGfaGfuuaassc | 605 | UAGGAUAACAGAUGAGUUAAC | 1115 |
| AM15062-AS | cPrpuAfggAfuaAfcagauGfaGfuuaassg | 606 | UAGGAUAACAGAUGAGUUAAG | 1090 |
| AM15245-AS | usGfsasUfagaggAfuUfaAfaGfugagsg | 607 | UGAUAGAGGAUUAAAGUGAGG | 1084 |
| AM15246-AS | usGfsasUfagaggAfuUfaAfaGfugagssg | 608 | UGAUAGAGGAUUAAAGUGAGG | 1084 |
| AM15556-AS | cPrpusUfsuAfgagugagGfaUfuAfaAfaUfsg | 609 | UUUAGAGUGAGGAUUAAAAUG | 1116 |
| AM15751-AS | cPrpuGfauagaGfgAfuUfaAfaGfugagsg | 610 | UGAUAGAGGAUUAAAGUGAGG | 1084 |
| AM15932-AS | cPrpusGfsasuAUNAgAfggAfuUfaAfaGfugagsg | 611 | UGAUAGAGGAUUAAAGUGAGG | 1084 |
| AM15933-AS | cPrpusGfsasuaGUNAfggAfuUfaAfaGfugagsg | 612 | UGAUAGAGGAUUAAAGUGAGG | 1084 |
| AM15934-AS | cPrpusGfsasuagAUNAggAfuUfaAfaGfugagsg | 613 | UGAUAGAGGAUUAAAGUGAGG | 1084 |
| AM15935-AS | cPrpusGfsasuagGfggAfuUfaAfaGfugagsg | 614 | UGAUAGGGGAUUAAAGUGAGG | 1117 |
| AM15936-AS | cPrpusGfsasuagaGUNAfgAfuUfaAfaGfugagsg | 615 | UGAUAGAGGAUUAAAGUGAGG | 1084 |
| AM16051-AS | PrpusgsasuagagGfAfUfuaaagugagsgs(invAb) | 616 | UGAUAGAGGAUUAAAGUGAGG | 1084 |
| AM16114-AS | cPrpusgsasuAfgAfggAfuUfaaaGfuGfagsg | 618 | UGAUAGAGGAUUAAAGUGAGG | 1084 |
| AM16144-AS | cPrpuAfgGfAUNAuaacagAfuGfaGfuuaassg | 620 | UAGGAUAACAGAUGAGUUAAG | 1090 |
| AM16145-AS | cPrpuAfgGfaUUNAaacagAfuGfaGfuuaassg | 621 | UAGGAUAACAGAUGAGUUAAG | 1090 |
| AM16146-AS | cPrpuAfgGfauAUNAacagAfuGfaGfuuaassg | 622 | UAGGAUAACAGAUGAGUUAAG | 1090 |
| AM16147-AS | cPrpuAfgGfauaAUNAcagAfuGfaGfuuaassg | 623 | UAGGAUAACAGAUGAGUUAAG | 1090 |
| AM16169-AS | cPrpusGfsasGfaUfcacagAfaUfcUfuCfaasc | 624 | UGAGAUCACAGAAUCUUCAAC | 1105 |
| AM16171-AS | cPrpusGfsgsAfuAfacagaUfgAfgUfuAfagsg | 625 | UGGAUAACAGAUGAGUUAAGG | 1118 |
| AM16173-AS | cPrpusCfsusAfgCfaggauAfaCfaGfaUfgasg | 626 | UCUAGCAGGAUAACAGAUGAG | 1119 |
| AM16175-AS | cPrpusUfsasCfaUfuucuaCfaGfcUfaGfcasg | 627 | UUACAUUUCUACAGCUAGCAG | 1120 |
| AM16177-AS | cPrpusGfsusGfuUfuaaugUfuUfaUfcAfgggsg | 628 | UGUGUUUAAUGUUUAUCAGGG | 1121 |
| AM16179-AS | cPrpusAfsasGfaUfuacagUfgUfuUfaAfugsc | 629 | UAAGAUUACAGUGUUUAAUGC | 1122 |
| AM16181-AS | cPrpusAfsasUfcUfuccaaGfuGfaUfcAfuasg | 630 | UAAUCUUCCAAGUGAUCAUAG | 1123 |
| AM16183-AS | cPrpusAfsgsUfcUfggcaaAfaUfaCfaGfgusc | 631 | UAGUCUGGCAAAAUACAGGUC | 1124 |
| AM16238-AS | cPrpasUfsgsAfaCfauggaAfuCfcAfuGfcasg | 632 | AUGAACAUGGAAUCCAUGCAG | 1125 |
| AM16240-AS | cPrpusCfsusUfuUfucaugGfaCfcAfcCfagsu | 633 | UCUUUUUCAUGGACCACCAGU | 1126 |
| AM16242-AS | cPrpasAfsgsUfcAfucugcUfuUfuUfcAfugsg | 634 | AAGUCAUCUGCUUUUUCAUGG | 1127 |
| AM16244-AS | cPrpusUfsasCfuUfucuucAfuUfuCfcAfccsu | 635 | UUACUUUCUUCAUUUCCACCU | 1114 |

TABLE 3-continued

SOD1 RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| AM16246-AS | cPrpusGfsasUfaAfcagauGfaGfuUfaAfggsg | 636 | UGAUAACAGAUGAGUUAAGGG | 1128 |
| AM16248-AS | cPrpusCfsasGfAfuaacaGfaUfgAfgUfuasg | 637 | UCAGGAUAACAGAUGAGUUAG | 1129 |
| AM16250-AS | cPrpusAfsgsCfuAfgcaggAfuAfaCfaGfausg | 638 | UAGCUAGCAGGAUAACAGAUG | 1130 |
| AM16252-AS | cPrpusAfscsAfuUfucuacAfgCfuAfgCfagsg | 639 | UACAUUUCUACAGCUAGCAGG | 1131 |
| AM16254-AS | cPrpusUfsgsAfaAfcagacAfuUfuUfaAfcusg | 640 | UUGAAACAGACAUUUUAACUG | 1132 |
| AM16256-AS | cPrpasGfsgsUfcAfuugaaAfcAfgAfcAfuusc | 641 | AGGUCAUUGAAACAGACAUUC | 1133 |
| AM16258-AS | cPrpusAfsasGfuUfuaauaCfcCfaUfcUfgusg | 642 | UAAGUUUAUACCCAUCUGUG | 1134 |
| AM16260-AS | cPrpasCfsasAfgUfuuaauAfcCfcAfuCfugsc | 643 | ACAAGUUUAUACCCAUCUGC | 1135 |
| AM16950-AS | cPrpusGfsasGfaucacagAfaUfcUfucaasc | 644 | UGAGAUCACAGAAUCUUCAAC | 1105 |
| AM16951-AS | cPrpusGfsasGfaucacagAfaUfcUfucasasc | 645 | UGAGAUCACAGAAUCUUCAAC | 1105 |
| AM16952-AS | cPrpusGfsaGfaucacagAfaUfcUfucasasc | 646 | UGAGAUCACAGAAUCUUCAAC | 1105 |
| AM16953-AS | cPrpusGfsaGfaucacagAfaUfcUfucaassc | 647 | UGAGAUCACAGAAUCUUCAAC | 1105 |
| AM16955-AS | cPrpusGfsaGfauCUNAacagAfaUfcUfucasasc | 648 | UGAGAUCACAGAAUCUUCAAC | 1105 |
| AM16956-AS | cPrpusGfsaGfaUUNAcacagAfaUfcUfucasasc | 649 | UGAGAUCACAGAAUCUUCAAC | 1105 |
| AM16957-AS | cPrpusGfsagauCfacagAfaUfcUfucasasc | 650 | UGAGAUCACAGAAUCUUCAAC | 1105 |
| AM16958-AS | cPrpusGfsagaucacagaaUfcUfucasasc | 651 | UGAGAUCACAGAAUCUUCAAC | 1105 |
| AM12559-AS | ususUfAfgagugagGfaUfuAfaAfaUfsg | 652 | UUUAGAGUGAGGAUUAAAAUG | 1116 |
| AM14500-AS | usCfsasUfguuucuuAfgAfgUfgAfgGfsa | 653 | UCAUGUUUCUUAGAGUGAGGA | 1136 |
| AM13980-AS | cPrpusUfsusAfgAfgUfgAfgGfaUfusAfsasAfsasu | 654 | UUUAGAGUGAGGAUUAAAAU | 1137 |
| AM15558-AS | cPrpuUfuagagugagGfaUfuAfaAfaUfsg | 655 | UUUAGAGUGAGGAUUAAAAUG | 1116 |
| AM12560-AS | cPrpusUfsusAfgagugagGfaUfuAfaAfaUfsg | 656 | UUUAGAGUGAGGAUUAAAAUG | 1116 |
| AM14510-AS | usUfsusUfgagggguaGfcAfgAfuGfaGfsu | 657 | UUUUGAGGGUAGCAGAUGAGU | 1138 |
| AM14516-AS | usAfscsAfacucuucAfgAfuUfaCfaGfsu | 658 | UACAACUCUUCAGAUUACAGU | 1139 |
| AM13589-AS | cPrpuUfuAfgagugagGfaUfuAfaAfaUfsg | 659 | UUUAGAGUGAGGAUUAAAAUG | 1116 |
| AM16904-AS | cPrpusUfsusagAfgUfGfaggaUfuAfaaausg | 660 | UUUAGAGUGAGGAUUAAAAUG | 1116 |
| AM15424-AS | cPrpusUfsusagagugagGfaUfuAfaaaussg | 661 | UUUAGAGUGAGGAUUAAAAUG | 1116 |
| AM15556-AS | cPrpusUfsuAfgagugagGfaUfuAfaAfaUfsg | 662 | UUUAGAGUGAGGAUUAAAAUG | 1116 |
| AM15242-AS | cPrpusAfscsAfguuuaAfuGfgUfuUfgaggssg | 663 | UACAGUUUAAUGGUUUGAGGG | 1140 |
| AM14512-AS | usAfscsAfguuuaauGfgUfuUfgAfgGfsg | 664 | UACAGUUUAAUGGUUUGAGGG | 1140 |
| AM14514-AS | usCfsasGfauuacagUfuUfaAfuGfgUfsu | 666 | UCAGAUUACAGUUUAAUGGUU | 1141 |
| AM13978-AS | cPrpusUfsusAfgAfgUfgAfgGfaUfuAfaAfausg | 667 | UUUAGAGUGAGGAUUAAAAUG | 1116 |
| AM14498-AS | usAfsgsGfauuaaaaUfgAfgGfuCfcUfsg | 668 | UAGGAUUAAAAUGAGGUCCUG | 1142 |
| AM17087-AS | (invAb)susususagaguGfAfGfgauuaaaausgs(invAb) | 669 | UUUAGAGUGAGGAUUAAAAUG | 1116 |
| AM14508-AS | usGfsusCfuuuguacUfuUfcUfuCfaUfsu | 670 | UGUCUUUGUACUUUCUUCAUU | 1143 |
| AM14275-AS | cPrpusUfsusagAfgUfGfaggaUfuAfaaaugsasg | 671 | UUUAGAGUGAGGAUUAAAAUGAG | 1144 |
| AM15557-AS | cPrpusUfuAfgagugagGfaUfuAfaAfaUfsg | 672 | UUUAGAGUGAGGAUUAAAAUG | 1116 |
| AM14506-AS | ususUfsasCfuuucuucAfuUfuCfcAfcCfsu | 673 | UUACUUUCUUCAUUUCCACCU | 1114 |

TABLE 3-continued

SOD1 RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| AM14504-AS | usUfscsAfucuuguuUfcUfcAfuGfgAfsc | 674 | UUCAUCUUGUUUCUCAUGGAC | 1145 |
| AM14937-AS | cPrpususAfgAfgUfgagGfauuAfaAfaUfgs(invAb) | 675 | UUUAGAGUGAGGAUUAAAAUG | 1116 |
| AM14307-AS | cPrpusUfsusAfgagugagGfaUfusAfsasAfsasUfsg | 676 | UUUAGAGUGAGGAUUAAAAUG | 1116 |
| AM15426-AS | cPrpusAfcaguuuaauGfgUfuUfgaggssg | 677 | UACAGUUUAAUGGUUUGAGGG | 1140 |
| AM15425-AS | cPrpusAfscsaguuuaauGfgUfuUfgaggssg | 678 | UACAGUUUAAUGGUUUGAGGG | 1140 |
| AM13976-AS | cPrpusUfsusAfgAfgugagGfaUfuUfaAfaAfausg | 679 | UUUAGAGUGAGGAUUAAAAUG | 1116 |
| AM14502-AS | usAfsasUfgauggaaUfgCfuCfuCfcUfsg | 680 | UAAUGAUGGAAUGCUCUCCUG | 1146 |

TABLE 4

SOD1 Agent Sense Strand Sequences (Shown Without Linkers, Conjugates, or Capping Moieties)

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM13283-SS | gaaaguaaUfGfGfaccagugaaa | 681 | GAAAGUAAUGGACCAGUGAAA | 1147 |
| AM13285-SS | gccugcauGfGfAfuuccauguua | 682 | GCCUGCAUGGAUUCCAUGUUA | 1148 |
| AM13287-SS | auuccaugUfUfCfaugaguuuga | 683 | AUUCCAUGUUCAUGAGUUUGA | 1149 |
| AM13289-SS | ugcaggucCfUfCfacuuuaauca | 684 | UGCAGGUCCUCACUUUAAUCA | 1150 |
| AM13291-SS | ccucacuuUfAfAfuccucuauca | 685 | CCUCACUUUAAUCCUCUAUCA | 1151 |
| AM13293-SS | aggaugaaGfAfGfaggcauguua | 686 | AGGAUGAAGAGAGGCAUGUUA | 1152 |
| AM13295-SS | cuauugaaGfAfUfucugugaucu | 687 | CUAUUGAAGAUUCUGUGAUCU | 1153 |
| AM13297-SS | uuggcuugUfGfGfuguaauugga | 688 | UUGGCUUGUGGUGUAAUUGGA | 1154 |
| AM13299-SS | ua_2NaacauuCfCfCfuuggauguaa | 689 | U(A$^{2N}$)AACAUUCCCUUGGAUGUAA | 1217 |
| AM13301-SS | cauucccuUfGfGfauguagucua | 690 | CAUUCCCUUGGAUGUAGUCUA | 1156 |
| AM13303-SS | cuuaacucAfUfCfuguuauccua | 691 | CUUAACUCAUCUGUUAUCCUA | 1157 |
| AM13305-SS | guuauccuGfCfUfagcuguagaa | 692 | GUUAUCCUGCUAGCUGUAGAA | 1158 |
| AM13307-SS | gcuagcugUfAfGfaaauguauca | 693 | GCUAGCUGUAGAAAUGUAUCA | 1159 |
| AM13309-SS | uagcuguaGfAfAfauguauccua | 694 | UAGCUGUAGAAAUGUAUCCUA | 1160 |
| AM13311-SS | gaaauguaUfCfCfugauaaacau | 695 | GAAAUGUAUCCUGAUAAACAU | 1161 |
| AM13313-SS | uccugauaAfAfCfauuaaacacu | 696 | UCCUGAUAAACAUUAAACACU | 1162 |
| AM13315-SS | a_2NaacauuaAfAfCfacuguaaucu | 697 | (A$^{2N}$)AACAUUAAACACUGUAAUCU | 1218 |
| AM13317-SS | ugcuuuaaAfGfUfaccuguagua | 698 | UGCUUUAAAGUACCUGUAGUA | 1164 |
| AM13319-SS | aaacugauUfUfAfugaucacuua | 699 | AAACUGAUUUAUGAUCACUUA | 1165 |
| AM13321-SS | cuuggaagAfUfUfuguauaguuu | 700 | CUUGGAAGAUUUGUAUAGUUU | 1166 |
| AM13323-SS | cuguuucaAfUfGfaccuguauuu | 701 | CUGUUUCAAUGACCUGUAUUU | 1167 |
| AM13325-SS | uuaaaucaCfAfGfaugggauaua | 702 | UUAAAUCACAGAUGGGUAUUA | 1168 |
| AM13327-SS | a_2NgauggguAfUfUfaaacuuguca | 703 | (A$^{2N}$)GAUGGGUAUUAAACUUGUCA | 1169 |

TABLE 4-continued

SOD1 Agent Sense Strand Sequences (Shown Without Linkers, Conjugates, or Capping Moieties)

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM13917-SS | cgagcagaAfGfGfaaaguaauga | 704 | CGAGCAGAAGGAAAGUAAUGA | 1170 |
| AM13919-SS | ccugcaugGfAfUfuccauguuca | 705 | CCUGCAUGGAUUCCAUGUUCA | 1171 |
| AM13921-SS | guugaagaUfUfCfugugaucuca | 706 | GUUGAAGAUUCUGUGAUCUCA | 1172 |
| AM13923-SS | ca_2NugaaaaAfGfCfagaugacuuu | 707 | C(A$^{2N}$)UGAAAAGCAGAUGACUUU | 1218 |
| AM13925-SS | auccugcuAfGfCfuguagaaauu | 708 | AUCCUGCUAGCUGUAGAAAUU | 1174 |
| AM13927-SS | uga_2NucacuUfGfGfaagauuuguu | 709 | UG(A$^{2N}$)UCACUUGGAAGAUUUGUU | 1219 |
| AM13929-SS | ucacagauGfGfGfuauuaaacuu | 710 | UCACAGAUGGGUAUUAAACUU | 1176 |
| AM13988-SS | ccucacuuUfAfAfuccucuauca | 711 | CCUCACUUUAAUCCUCUAUCA | 1151 |
| AM13997-SS | cgagcagaAfGfGfaaaguaauga | 712 | CGAGCAGAAGGAAAGUAAUGA | 1170 |
| AM13998-SS | ccugcaugGfAfUfuccauguuca | 713 | CCUGCAUGGAUUCCAUGUUCA | 1171 |
| AM13999-SS | guugaagaUfUfCfugugaucuca | 714 | GUUGAAGAUUCUGUGAUCUCA | 1172 |
| AM14000-SS | ca_2NugaaaaAfGfCfagaugacuuu | 715 | C(A$^{2N}$)UGAAAAGCAGAUGACUUU | 1218 |
| AM14001-SS | auccugcuAfGfCfuguagaaauu | 716 | AUCCUGCUAGCUGUAGAAAUU | 1174 |
| AM14002-SS | uga_2NucacuUfGfGfaagauuuguu | 717 | UG(A$^{2N}$)UCACUUGGAAGAUUUGUU | 1219 |
| AM14003-SS | ucacagauGfGfGfuauuaaacuu | 718 | UCACAGAUGGGUAUUAAACUU | 1176 |
| AM14004-SS | gaaauguaUfCfCfugauaaacau | 719 | GAAAUGUAUCCUGAUAAACAU | 1161 |
| AM14018-SS | gcucacuuUfAfAfuccucuauca | 720 | GCUCACUUUAAUCCUCUAUCA | 1177 |
| AM14025-SS | ucacuuUfAfAfuccucuauca | 721 | UCACUUUAAUCCUCUAUCA | 1178 |
| AM14089-SS | cuuaacucAfUfCfuguuauccua | 722 | CUUAACUCAUCUGUUAUCCUA | 1157 |
| AM14101-SS | ccuaacucAfUfCfuguuauccua | 723 | CCUAACUCAUCUGUUAUCCUA | 1179 |
| AM14105-SS | uaacucAfUfCfuguuauccua | 724 | UAACUCAUCUGUUAUCCUA | 1180 |
| AM14334-SS | gcucacuuUfAfAfuccucuauca | 725 | GCUCACUUUAAUCCUCUAUCA | 1177 |
| AM14340-SS | ccucacuuUfAfAfuccucuauua | 726 | CCUCACUUUAAUCCUCUAUUA | 1181 |
| AM14346-SS | ucacuuUfAfAfuccucuauca | 727 | UCACUUUAAUCCUCUAUCA | 1178 |
| AM14372-SS | ua_2NacucAfUfCfuguuauccua | 728 | U(A$^{2N}$)ACUCAUCUGUUAUCCUA | 1220 |
| AM15049-SS | ccucAfcuuUfAfAfUfccucuauca | 729 | CCUCACUUUAAUCCUCUAUCA | 1151 |
| AM15051-SS | gcucAfcuuUfAfAfUfccucuauca | 730 | GCUCACUUUAAUCCUCUAUCA | 1177 |
| AM15053-SS | guuaacucAfUfCfuguuauccua | 731 | GUUAACUCAUCUGUUAUCCUA | 1182 |
| AM15057-SS | cuuaAfcucAfUfCfUfguuauccua | 732 | CUUAACUCAUCUGUUAUCCUA | 1157 |
| AM15752-SS | ccucAfcuuUfAfAfUfccucuauca | 733 | CCUCACUUUAAUCCUCUAUCA | 1151 |
| AM15931-SS | ccucacuuUfAfAfuccucuauca | 734 | CCUCACUUUAAUCCUCUAUCA | 1151 |
| AM16118-SS | ca_2NugaaaaAfGfCfagaugacuuu | 735 | C(A$^{2N}$)UGAAAAGCAGAUGACUUU | 1218 |
| AM16119-SS | cuuaacucAfUfCfuguuauccua | 736 | CUUAACUCAUCUGUUAUCCUA | 1157 |
| AM16120-SS | guuauccGfCfUfagcuguagaa | 737 | GUUAUCCUGCUAGCUGUAGAA | 1158 |
| AM16121-SS | uccugauaAfAfCfauuaaacacu | 738 | UCCUGAUAAACAUUAAACACU | 1162 |
| AM16168-SS | guugaagaUfUfCfugugaucuca | 739 | GUUGAAGAUUCUGUGAUCUCA | 1172 |

TABLE 4-continued

SOD1 Agent Sense Strand Sequences (Shown Without Linkers, Conjugates, or Capping Moieties)

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM16170-SS | ccuuaacuCfAfUfcuguuaucca | 740 | CCUUAACUCAUCUGUUAUCCA | 1183 |
| AM16172-SS | cucaucugUfUfAfuccugcuaga | 741 | CUCAUCUGUUAUCCUGCUAGA | 1184 |
| AM16174-SS | cugcuagcUfGfUfagaaauguaa | 742 | CUGCUAGCUGUAGAAAUGUAA | 1185 |
| AM16176-SS | cccugauaAfAfCfauuaaacaca | 743 | CCCUGAUAAACAUUAAACACA | 1186 |
| AM16178-SS | gca_2NuuaaaCfAfCfuguaaucuua | 744 | GC(A$^{2N}$)UUUAAACACUGUAAUCUUA | 1221 |
| AM16180-SS | cua_2NugaucAfCfUfuggaagauua | 745 | CU(A$^{2N}$)UGAUCACUUGGAAGAUUA | 1222 |
| AM16182-SS | gaccuguaUfUfUfugccagacua | 746 | GACCUGUAUUUGCCAGACUA | 1189 |
| AM16237-SS | cugcauggAfUfUfccauguucau | 747 | CUGCAUGGAUUCCAUGUUCAU | 1190 |
| AM16239-SS | acuggugGfUfCfcaugaaaaga | 748 | ACUGGUGGUCCAUGAAAAGA | 1191 |
| AM16241-SS | ccaugaaaAfAfGfcagaugacuu | 749 | CCAUGAAAAGCAGAUGACUU | 1192 |
| AM16243-SS | agguggaaAfUfGfaagaaaguaa | 750 | AGGUGGAAAUGAAGAAAGUAA | 1193 |
| AM16245-SS | cccuuaacUfCfAfucuguuauca | 751 | CCCUUAACUCAUCUGUUAUCA | 1194 |
| AM16247-SS | cua_2NacucaUfCfUfguuauccuga | 752 | CU(A$^{2N}$)ACUCAUCUGUUAUCCUGA | 1223 |
| AM16249-SS | caucuguuAfUfCfcugcuaguus | 753 | CAUCUGUUAUCCUGCUAGUUA | 1196 |
| AM16251-SS | ccugcuagCfUfGfuagaaaugus | 754 | CCUGCUAGCUGUAGAAAUGUA | 1197 |
| AM16253-SS | caguuaaaAfUfGfucuguuucaas | 755 | CAGUUAAAAUGUCUGUUUCAA | 1198 |
| AM16255-SS | ga_2NaugucuGfUfUfucaaugacuu | 756 | G(A$^{2N}$)AUGUCUGUUUCAAUGACUU | 1224 |
| AM16257-SS | cacagaugGfUfUfauuaaacuua | 757 | CACAGAUGGGUAUUAAACUUA | 1200 |
| AM16259-SS | gcagauggGfUfAfuuaaacuugu | 758 | GCAGAUGGGUAUUAAACUUGU | 1201 |
| AM16616-SS | cuuaacucAfUfCfuguuauccua | 759 | CUUAACUCAUCUGUUAUCCUA | 1157 |
| AM16617-SS | ccucacuuUfAfAfuccucuauca | 760 | CCUCACUUUAAUCCUCUAUCA | 1151 |
| AM16618-SS | ca_2NugaaaaAfGfCfagaugacuuu | 761 | C(A$^{2N}$)UGAAAAGCAGAUGACUUU | 1218 |
| AM16619-SS | ucacagauGfGfGfuauuaaacuu | 762 | UCACAGAUGGGUAUUAAACUU | 1176 |
| AM16672-SS | ccucacuuUfAfAfuccucuauca | 763 | CCUCACUUUAAUCCUCUAUCA | 1151 |
| AM16688-SS | ccucacuuUfAfAfuccucuauca | 764 | CCUCACUUUAAUCCUCUAUCA | 1151 |
| AM16705-SS | ccucacuuUfAfAfuccucuauca | 765 | CCUCACUUUAAUCCUCUAUCA | 1151 |
| AM16706-SS | ccucacuuUfAfAfuccucuauca | 766 | CCUCACUUUAAUCCUCUAUCA | 1151 |
| AM16800-SS | ccucacuuUfAfAfuccucuauca | 767 | CCUCACUUUAAUCCUCUAUCA | 1151 |
| AM16814-SS | ccucacuuUfAfAfuccucuauca | 768 | CCUCACUUUAAUCCUCUAUCA | 1151 |
| AM16815-SS | ccucacuuUfAfAfuccucuauca | 769 | CCUCACUUUAAUCCUCUAUCA | 1151 |
| AM16949-SS | guugaagaUfUfCfugugaucuca | 770 | GUUGAAGAUUCUGUGAUCUCA | 1172 |
| AM16954-SS | guugaagaUfuCfuGfugaucuca | 771 | GUUGAAGAUUCUGUGAUCUCA | 1172 |
| AM17192-SS | ccucacuuUfAfAfuccucuauca | 772 | CCUCACUUUAAUCCUCUAUCA | 1151 |
| AM13767-SS | cauuuuaaUfCfCfucaAlkcucuaaa | 773 | CAUUUUAAUCCUCACUCUAAA | 1202 |
| AM14676-SS | guccaugaGfAfAfacaagaugaa | 774 | GUCCAUGAGAAACAAGAUGAA | 1203 |
| AM14520-SS | cauuuuaaUfCfCfucacucuaaa | 775 | CAUUUUAAUCCUCACUCUAAA | 1202 |

TABLE 4-continued

SOD1 Agent Sense Strand Sequences (Shown Without Linkers, Conjugates, or Capping Moieties)

| Strand

TABLE 4-continued

SOD1 Agent Sense Strand Sequences (Shown Without Linkers, Conjugates, or Capping Moieties)

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM13975-SS | cauuuuaaUfCfCfucacucuaaa | 812 | CAUUUUAAUCCUCACUCUAAA | 1202 |
| AM14509-SS | acucaucuGfCfUfacccucaaaa | 813 | ACUCAUCUGCUACCCUCAAAA | 1205 |
| AM16903-SS | cauuuuAfaUfCfCfucacucuaaa | 814 | CAUUUUAAUCCUCACUCUAAA | 1202 |
| AM15560-SS | cauuuuaaUfCfCfucacucuaa_2Na | 815 | CAUUUUAAUCCUCACUCUA(A$^{2N}$)A | 1227 |
| AM14513-SS | aaccauuaAfAfCfuguaaucuga | 816 | AACCAUUAAACUGUAAUCUGA | 1210 |
| AM14673-SS | caggaccuCfAfUfuuuaauccua | 817 | CAGGACCUCAUUUUAAUCCUA | 1211 |
| AM14501-SS | caggagagCfAfUfuccaucauua | 818 | CAGGAGAGCAUUCCAUCAUUA | 1209 |
| AM-17382-SS | guugaagaUfuCfUfGfugaucuca | 819 | GUUGAAGAUUCUGUGAUCUCA | 1172 |

($A^{2N}$) = 2-aminoadenosine nucleotide

TABLE 5

SOD1 Agent Sense Strand Sequences (Shown With (NH2-C6) Linker, (NAG37)s ligand, or (invAb) end cap (see Table 11 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM13283-SS | (NH2-C6)s(invAb)sgaaaguaaUfGfGfaccagugaaas(invAb) | 820 | GAAAGUAAUGGACCAGUGAAA | 1147 |
| AM13285-SS | (NH2-C6)s(invAb)sgccugcauGfGfAfuuccauguuas(invAb) | 821 | GCCUGCAUGGAUUCCAUGUUA | 1148 |
| AM13287-SS | (NH2-C6)s(invAb)sauuccaugUfUfCfaugaguuugas(invAb) | 822 | AUUCCAUGUUCAUGAGUUUGA | 1149 |
| AM13289-SS | (NH2-C6)s(invAb)sugcagguCfUfCfacuuuaaucas(invAb) | 823 | UGCAGGUCCUCACUUUAAUCA | 1150 |
| AM13291-SS | (NH2-C6)s(invAb)sccucacuuUfAfAfuccucuaucas(invAb) | 824 | CCUCACUUUAAUCCUCUAUCA | 1151 |
| AM13293-SS | (NH2-C6)s(invAb)saggaugaaGfAfGfaggcauguuas(invAb) | 825 | AGGAUGAAGAGAGGCAUGUUA | 1152 |
| AM13295-SS | (NH2-C6)s(invAb)scuauugaaGfAfUfucugugaucus(invAb) | 826 | CUAUUGAAGAUUCUGUGAUCU | 1153 |
| AM13297-SS | (NH2-C6)s(invAb)suuggcuugUfGfGfuguaauuggas(invAb) | 827 | UUGGCUUGUGGUGUAAUUGGA | 1154 |
| AM13299-SS | (NH2-C6)s(invAb)sua_2NaacauuCfCfCfuuggauguaas(invAb) | 828 | U(A$^{2N}$)AACAUUCCCUUGGAUGUAA | 1217 |
| AM13301-SS | (NH2-C6)s(invAb)scauucccuUfGfGfauguagucuas(invAb) | 829 | CAUUCCCUUGGAUGUAGUCUA | 1156 |
| AM13303-SS | (NH2-C6)s(invAb)scuuaacucAfUfCfuguuauccuas(invAb) | 830 | CUUAACUCAUCUGUUAUCCUA | 1157 |
| AM13305-SS | (NH2-C6)s(invAb)sguuauccuGfCfUfagcuguagaas(invAb) | 831 | GUUAUCCUGCUAGCUGUAGAA | 1158 |
| AM13307-SS | (NH2-C6)s(invAb)sgcuagcugUfAfGfaaauguaucas(invAb) | 832 | GCUAGCUGUAGAAAUGUAUCA | 1159 |
| AM13309-SS | (NH2-C6)s(invAb)suagcuguaGfAfAfauguauccuas(invAb) | 833 | UAGCUGUAGAAAUGUAUCCUA | 1160 |
| AM13311-SS | (NH2-C6)s(invAb)sgaaauguaUfCfCfugauaaacaus(invAb) | 834 | GAAAUGUAUCCUGAUAAACAU | 1161 |
| AM13313-SS | (NH2-C6)s(invAb)succugauaAfAfCfauuaaacacus(invAb) | 835 | UCCUGAUAAACAUUAAACACU | 1162 |
| AM13315-SS | (NH2-C6)s(invAb)sa_2NaacauuaAfAfCfacuguaaucus(invAb) | 836 | (A$^{2N}$)AACAUUAAACACUGUAAUCU | 1129 |
| AM13317-SS | (NH2-C6)s(invAb)sugcuuuaaAfGfUfaccuguaguas(invAb) | 837 | UGCUUUAAAGUACCUGUAGUA | 1164 |
| AM13319-SS | (NH2-C6)s(invAb)saaacugauUfUfAfugaucacuuas(invAb) | 838 | AAACUGAUUUAUGAUCACUUA | 1165 |
| AM13321-SS | (NH2-C6)s(invAb)scuuggaagAfUfUfuguauaguuus(invAb) | 839 | CUUGGAAGAUUUGUAUAGUUU | 1166 |

TABLE 5-continued

SOD1 Agent Sense Strand Sequences (Shown With (NH2-C6) Linker, (NAG37)s ligand, or (invAb) end cap (see Table 11 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM13323-SS | (NH2-C6)s(invAb)scuguuucaAfUfGfaccuguauuus(invAb) | 840 | CUGUUUCAAUGACCUGUAUUU | 1167 |
| AM13325-SS | (NH2-C6)s(invAb)suuaaaucaCfAfGfaugggguauuas(invAb) | 841 | UUAAAUCACAGAUGGGUAUUA | 1168 |
| AM13327-SS | (NH2-C6)s(invAb)sa_2NgauggguAfUfUfaaacuugucas(invAb) | 842 | $(A^{2N})$GAUGGGUAUUAAACUUGUCA | 1169 |
| AM13917-SS | (NH2-C6)s(invAb)scgagcagaAfGfGfaaaguaaugas(invAb) | 843 | CGAGCAGAAGGAAAGUAAUGA | 1170 |
| AM13919-SS | (NH2-C6)s(invAb)sccugcaugGfAfUfuccauguucas(invAb) | 844 | CCUGCAUGGAUUCCAUGUUCA | 1171 |
| AM13921-SS | (NH2-C6)s(invAb)sguugaagaUfUfCfugugaucucas(invAb) | 845 | GUUGAAGAUUCUGUGAUCUCA | 1172 |
| AM13923-SS | (NH2-C6)s(invAb)sca_2NugaaaaAfGfCfagaugacuuus(invAb) | 846 | C$(A^{2N})$UGAAAAGCAGAUGACUUU | 1218 |
| AM13925-SS | (NH2-C6)s(invAb)sauccugcuAfGfCfuguagaaauus(invAb) | 847 | AUCCUGCUAGCUGUAGAAAUU | 1174 |
| AM13927-SS | (NH2-C6)s(invAb)suga_2NucacuUfGfGfaagauuuguus(invAb) | 848 | UG$(A^{2N})$UCACUUGGAAGAUUUGUU | 1219 |
| AM13929-SS | (NH2-C6)s(invAb)sucacagauGfGfGfuauuaaacuus(invAb) | 849 | UCACAGAUGGGUAUUAAACUU | 1176 |
| AM13988-SS | (NAG37)s(invAb)sccucacuuUfAfAfuccucuaucas(invAb) | 850 | CCUCACUUUAAUCCUCUAUCA | 1151 |
| AM13997-SS | (NAG37)s(invAb)scgagcagaAfGfGfaaaguaaugas(invAb) | 851 | CGAGCAGAAGGAAAGUAAUGA | 1170 |
| AM13998-SS | (NAG37)s(invAb)sccugcaugGfAfUfuccauguucas(invAb) | 852 | CCUGCAUGGAUUCCAUGUUCA | 1171 |
| AM13999-SS | (NAG37)s(invAb)sguugaagaUfUfCfugugaucucas(invAb) | 853 | GUUGAAGAUUCUGUGAUCUCA | 1172 |
| AM14000-SS | (NAG37)s(invAb)sca_2NugaaaaAfGfCfagaugacuuus(invAb) | 854 | C$(A^{2N})$UGAAAAGCAGAUGACUUU | 1218 |
| AM14001-SS | (NAG37)s(invAb)sauccugcuAfGfCfuguagaaauus(invAb) | 855 | AUCCUGCUAGCUGUAGAAAUU | 1174 |
| AM14002-SS | (NAG37)s(invAb)suga_2NucacuUfGfGfaagauuuguus(invAb) | 856 | UG$(A^{2N})$UCACUUGGAAGAUUUGUU | 1219 |
| AM14003-SS | (NAG37)s(invAb)sucacagauGfGfGfuauuaaacuus(invAb) | 857 | UCACAGAUGGGUAUUAAACUU | 1176 |
| AM14004-SS | (NAG37)s(invAb)sgaaauguaUfCfCfugauaaacaus(invAb) | 858 | GAAAUGUAUCCUGAUAAACAU | 1161 |
| AM14018-SS | (NAG37)s(invAb)sgcucacuuUfAfAfuccucuaucas(invAb) | 859 | GCUCACUUUAAUCCUCUAUCA | 1177 |
| AM14025-SS | (NAG37)s(invAb)sucacuuUfAfAfuccucuaucas(invAb) | 860 | UCACUUUAAUCCUCUAUCA | 1178 |
| AM14089-SS | (NAG37)s(invAb)scuuaacucAfUfCfuguuauccaas(invAb) | 861 | CUUAACUCAUCUGUUAUCCA | 1157 |
| AM14101-SS | (NAG37)s(invAb)sccuaacucAfUfCfuguuauccuas(invAb) | 862 | CCUAACUCAUCUGUUAUCCUA | 1179 |
| AM14105-SS | (NAG37)s(invAb)suaacucAfUfCfuguuauccuas(invAb) | 863 | UAACUCAUCUGUUAUCCUA | 1180 |
| AM14276-SS | (invAb)sccucacuC16uUfAfAfuccucuaucas(invAb) | 864 | CCUCACUUUAAUCCUCUAUCA | 1151 |
| AM14278-SS | (invAb)scuuaacuC16cAfUfCfuguuauccaas(invAb) | 865 | CUUAACUCAUCUGUUAUCCA | 1157 |
| AM14334-SS | (NH2-C6)s(invAb)sgcucacuuUfAfAfuccucuaucas(invAb) | 866 | GCUCACUUUAAUCCUCUAUCA | 1177 |
| AM14340-SS | (NH2-C6)s(invAb)sccucacuuUfAfAfuccucuauuas(invAb) | 867 | CCUCACUUUAAUCCUCUAUUA | 1181 |
| AM14346-SS | (NH2-C6)s(invAb)sucacuuUfAfAfuccucuaucas(invAb) | 868 | UCACUUUAAUCCUCUAUCA | 1178 |
| AM14372-SS | (NH2-C6)s(invAb)sua_2Nacuc AfUfCfuguuauccaas(invAb) | 869 | U$(A^{2N})$ACUCAUCUGUUAUCCA | 1220 |
| AM15049-SS | (NH2-C6)s(invAb)sccucAfcuuUfAfAfuccucuaucas(invAb) | 870 | CCUCACUUUAAUCCUCUAUCA | 1151 |
| AM15051-SS | (NH2-C6)s(invAb)sgcucAfcuuUfAfAfuccucuaucas(invAb) | 871 | GCUCACUUUAAUCCUCUAUCA | 1177 |
| AM15053-SS | (NH2-C6)s(invAb)sguuaacucAfUfCfuguuauccaas(invAb) | 872 | GUUAACUCAUCUGUUAUCCA | 1182 |

TABLE 5-continued

SOD1 Agent Sense Strand Sequences (Shown With (NH2-C6) Linker, (NAG37)s ligand, or (invAb) end cap (see Table 11 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM15057-SS | (NH2-C6)s(invAb)scuuaAfcucAfUfCfUfguuauccuas(invAb) | 873 | CUUAACUCAUCUGUUAUCCUA | 1157 |
| AM15752-SS | (NH2-C6)s(invAb)sccucAfcuuUfAfAfUfccucuaucas(invAb) | 874 | CCUCACUUUAAUCCUCUAUCA | 1151 |
| AM15931-SS | (NH2-C6)s(invAb)sccucacuuUfAfAfuccucuaucas(invAb) | 875 | CCUCACUUUAAUCCUCUAUCA | 1151 |
| AM16019-SS | (invAb)sccuC16cacuuUfAfAfuccucuaucas(invAb) | 876 | CCUCACUUUAAUCCUCUAUCA | 1151 |
| AM16020-SS | (invAb)sccucaC16cuuUfAfAfuccucuaucas(invAb) | 877 | CCUCACUUUAAUCCUCUAUCA | 1151 |
| AM16021-SS | (invAb)sccucacuuC16UfAfAfuccucuaucas(invAb) | 878 | CCUCACUUUAAUCCUCUAUCA | 1151 |
| AM16022-SS | (invAb)sccucacuuUfAfAfuccuC16cuaucas(invAb) | 879 | CCUCACUUUAAUCCUCUAUCA | 1151 |
| AM16023-SS | (invAb)sccucacuuUfAfAfuccucuauC16cas(invAb) | 880 | CCUCACUUUAAUCCUCUAUCA | 1151 |
| AM16024-SS | (invAb)sccucacuuUfAfAfuccucuC16aucas(invAb) | 881 | CCUCACUUUAAUCCUCUAUCA | 1151 |
| AM16118-SS | (NH2-C6)s(invAb)sca_2NugaaaaAfGfCfagaugacuuus(invAb) | 882 | C(A$^{2N}$)UGAAAAGCAGAUGACUUU | 1218 |
| AM16119-SS | (NH2-C6)s(invAb)scuuaacucAfUfCfuguuauccuas(invAb) | 883 | CUUAACUCAUCUGUUAUCCUA | 1157 |
| AM16120-SS | (NH2-C6)s(invAb)sguuauccuGfCfUfagcuguagaas(invAb) | 884 | GUUAUCCUGCUAGCUGUAGAA | 1158 |
| AM16121-SS | (NH2-C6)s(invAb)succugauaAfAfCfauuaaacacus(invAb) | 885 | UCCUGAUAAACAUUAAACACU | 1162 |
| AM16136-SS | (invAb)scuuaacucAfUfCfuguuauccuC16as(invAb) | 886 | CUUAACUCAUCUGUUAUCCUA | 1157 |
| AM16137-SS | (invAb)scuuaacucAfUfCfuguuauC16ccuas(invAb) | 887 | CUUAACUCAUCUGUUAUCCUA | 1157 |
| AM16138-SS | (invAb)scuuaacucAfUfCfuguC16uauccuas(invAb) | 888 | CUUAACUCAUCUGUUAUCCUA | 1157 |
| AM16139-SS | (invAb)scuuaacucAfUfCfuC16guuauccuas(invAb) | 889 | CUUAACUCAUCUGUUAUCCUA | 1157 |
| AM16140-SS | (invAb)scuuC16aacucAfUfCfuguuauccuas(invAb) | 890 | CUUAACUCAUCUGUUAUCCUA | 1157 |
| AM16141-SS | (invAb)scuC16uaacucAfUfCfuguuauccuas(invAb) | 891 | CUUAACUCAUCUGUUAUCCUA | 1157 |
| AM16168-SS | (NH2-C6)s(invAb)sguugaagaUfUfCfugugaucucas(invAb) | 892 | GUUGAAGAUUCUGUGAUCUCA | 1172 |
| AM16170-SS | (NH2-C6)s(invAb)sccuuaacuCfAfUfcuguuauccas(invAb) | 893 | CCUUAACUCAUCUGUUAUCCA | 1183 |
| AM16172-SS | (NH2-C6)s(invAb)scucaucugUfUfAfuccugcuagas(invAb) | 894 | CUCAUCUGUUAUCCUGCUAGA | 1184 |
| AM16174-SS | (NH2-C6)s(invAb)scugcuagcUfGfUfagaaauguaas(invAb) | 895 | CUGCUAGCUGUAGAAAUGUAA | 1185 |
| AM16176-SS | (NH2-C6)s(invAb)scccugauaAfAfCfauuaaacacas(invAb) | 896 | CCCUGAUAAACAUUAAACACA | 1186 |
| AM16178-SS | (NH2-C6)s(invAb)sgca_2NuuaaaCfAfCfuguaaucuuas(invAb) | 897 | GC(A$^{2N}$)UUAAACACUGUAAUCUUA | 1221 |
| AM16180-SS | (NH2-C6)s(invAb)scua_2NugaucAfCfUfuggaagauuas(invAb) | 898 | CU(A$^{2N}$)UGAUCACUUGGAAGAUUA | 1222 |
| AM16182-SS | (NH2-C6)s(invAb)sgaccuguaUfUfUfugccagacuas(invAb) | 899 | GACCUGUAUUUUGCCAGACUA | 1189 |
| AM16237-SS | (NH2-C6)s(invAb)scugcauggAfUfUfccauguucaus(invAb) | 900 | CUGCAUGGAUUCCAUGUUCAU | 1190 |
| AM16239-SS | (NH2-C6)s(invAb)sacugguggUfCfCfaugaaaaagas(invAb) | 901 | ACUGGUGGUCCAUGAAAAAGA | 1191 |
| AM16241-SS | (NH2-C6)s(invAb)sccaugaaaAfAfGfcagaugacuus(invAb) | 902 | CCAUGAAAAGCAGAUGACUU | 1192 |
| AM16243-SS | (NH2-C6)s(invAb)sagguggaaAfUfGfaagaaaguaas(invAb) | 903 | AGGUGGAAAUGAAGAAAGUAA | 1193 |
| AM16245-SS | (NH2-C6)s(invAb)scccuuaacUfCfAfucuguuaucas(invAb) | 904 | CCCUUAACUCAUCUGUUAUCA | 1194 |
| AM16247-SS | (NH2-C6)s(invAb)scua_2NacucaUfCfUfguuauccugas(invAb) | 905 | CU(A$^{2N}$)ACUCAUCUGUUAUCCUGA | 1223 |
| AM16249-SS | (NH2-C6)s(invAb)scaucuguuAfUfCfcugcuaguuas(invAb) | 906 | CAUCUGUUAUCCUGCUAGUUA | 1196 |
| AM16251-SS | (NH2-C6)s(invAb)sccugcuagCfUfGfuagaaaugaas(invAb) | 907 | CCUGCUAGCUGUAGAAAUGAA | 1197 |

TABLE 5-continued

SOD1 Agent Sense Strand Sequences (Shown With (NH2-C6) Linker, (NAG37)s ligand, or (invAb) end cap (see Table 11 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM16253-SS | (NH2-C6)s(invAb)scaguuaaaAfUfGfucuguuucaas(invAb) | 908 | CAGUUAAAUGUCUGUUUCAA | 1198 |
| AM16255-SS | (NH2-C6)s(invAb)sga_2NaugucuGfUfUfucaaugacuus(invAb) | 909 | G(A$^{2N}$)AUGUCUGUUUCAAUGACUU | 1224 |
| AM16257-SS | (NH2-C6)s(invAb)scacagaugGfGfUfauuaaacuuas(invAb) | 910 | CACAGAUGGGUAUUAAACUUA | 1200 |
| AM16259-SS | (NH2-C6)s(invAb)sgcagauggGfUfAfuuaaacuugus(invAb) | 911 | GCAGAUGGGUAUUAAACUUGU | 1201 |
| AM16616-SS | (NH2-C6)rs(invAb)scuuaacucAfUfCfuguuauccaas(invAb) | 912 | CUUAACUCAUCUGUUAUCCUA | 1157 |
| AM16617-SS | (NH2-C6)rs(invAb)sccucacuuUfAfAfuccucuaucas(invAb) | 913 | CCUCACUUUAAUCCUCUAUCA | 1151 |
| AM16618-SS | (NH2-C6)s(invAb)sca_2NugaaaaAfGfCfagaugacuuus(invAb) | 914 | C(A$^{2N}$)UGAAAAGCAGAUGACUUU | 1218 |
| AM16619-SS | (NH2-C6)s(invAb)sucacagauGfGfGfuauuaaacuus(invAb) | 915 | UCACAGAUGGGUAUUAAACUU | 1176 |
| AM16672-SS | (NH2-C6)s(invAb)sccucacuuUfAfAfuccucuaucas(invAb) | 916 | CCUCACUUUAAUCCUCUAUCA | 1151 |
| AM16688-SS | (NH2-C6)s(invAb)sccucacuuUfAfAfuccucuaucas(invAb) | 917 | CCUCACUUUAAUCCUCUAUCA | 1151 |
| AM16705-SS | (NH2-C6)s(invAb)sccucacuuUfAfAfuccucuaucas(invAb) | 918 | CCUCACUUUAAUCCUCUAUCA | 1151 |
| AM16706-SS | (invAb)sccucacuuUfAfAfuccucuaucas(invAb) | 919 | CCUCACUUUAAUCCUCUAUCA | 1151 |
| AM16800-SS | (invAb)sccucacuuUfAfAfuccucuaucas(invAb) | 920 | CCUCACUUUAAUCCUCUAUCA | 1151 |
| AM16814-SS | (invAb)sccucacuuUfAfAfuccucuaucas(invAb) | 921 | CCUCACUUUAAUCCUCUAUCA | 1151 |
| AM16815-SS | (invAb)sccucacuuUfAfAfuccucuaucas(invAb) | 922 | CCUCACUUUAAUCCUCUAUCA | 1151 |
| AM16949-SS | (NH2-C6)s(invAb)sguugaagaUfUfCfugugaucucas(invAb) | 923 | GUUGAAGAUUCUGUGAUCUCA | 1172 |
| AM16954-SS | (NH2-C6)s(invAb)sguugaagaUfuCfuGfugaucucas(invAb) | 924 | GUUGAAGAUUCUGUGAUCUCA | 1172 |
| AM17098-SS | (invAb)sccucacC16uuUfAfAfuccucuaucas(invAb) | 925 | CCUCAUUUAAUCCUCUAUCA | 1151 |
| AM17192-SS | (NH2-C6)s(invAb)sccucacuuUfAfAfuccucuaucas(invAb)(C6-SS-MeC5)dT | 926 | CCUCACUUUAAUCCUCUAUCAT | 1212 |
| AM13767-SS | (NH2-C6)s(invAb)scauuuuaaUfCfCfucaAlkcucuaaas(invAb)(C6-SS-C6)dT | 927 | CAUUUUAAUCCUCACUCUAAAT | 1213 |
| AM14676-SS | (NAG37)s(invAb)sguccaugaGfAfAfacaagaugaas(invAb) | 928 | GUCCAUGAGAAACAAGAUGAA | 1203 |
| AM14520-SS | (NH2-C6)scauuuuaaUfCfCfucacucuaaas(invAb) | 929 | CAUUUUAAUCCUCACUCUAAA | 1202 |
| AM14499-SS | (NH2-C6)succucacuCfUfAfagaaacaugas(invAb) | 930 | UCCUCACUCUAAGAAACAUGA | 1204 |
| AM14274-SS | (invAb)scauuuuC16AfaUfCfCfucacucuaaas(invAb) | 931 | CAUUUUAAUCCUCACUCUAAA | 1202 |
| AM13548-SS | (NH2-C6)s(invAb)scauuuuaaUfCfCfucacucuaaas(invAb)(C6-SS-C6)dT | 932 | CAUUUUAAUCCUCACUCUAAAT | 1213 |
| AM12590-SS | (NH2-C6)s(invAb)scauuuuaaUfCfCfucacucuaaas(invAb) | 933 | CAUUUUAAUCCUCACUCUAAA | 1202 |
| AM14677-SS | (NAG37)s(invAb)sagguggaaAfUfGfaagaaaguaas(invAb) | 934 | AGGUGGAAAUGAAGAAAGUAA | 1193 |
| AM14517-SS | (NH2-C6)(invAb)scauuuuaaUfCfCfucacucuaaas(invAb) | 935 | CAUUUUAAUCCUCACUCUAAA | 1202 |
| AM14679-SS | (NAG37)s(invAb)sacucaucuGfCfUfacccucaaas(invAb) | 936 | ACUCAUCUGCUACCCUCAAA | 1205 |
| AM13769-SS | (NH2-C6)s(invAb)scauuuuaaUfCfCfucacucuAlkaaas(invAb)s(C6-S-C6)dT | 937 | CAUUUUAAUCCUCACUCUAAAT | 1213 |
| AM14519-SS | (NH2-C6)scsauuuuaaUfCfCfucacucuaaas(invAb) | 938 | CAUUUUAAUCCUCACUCUAAA | 1202 |
| AM14680-SS | (NAG37)s(invAb)scccucaaaCfCfAfuuaaacuguas(invAb) | 939 | CCCUCAAACCAUUAAACUGUA | 1206 |

TABLE 5-continued

SOD1 Agent Sense Strand Sequences (Shown With (NH2-C6) Linker, (NAG37)s ligand, or (invAb) end cap (see Table 11 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM16116-SS | (NH2-C6)s(invAb)csauuuuaaUfCfCfucacucuaaas(invAb)sC(C6-SS-6)dT | 940 | CAUUUUAAUCCUCACUCUAAAT | 1213 |
| AM14507-SS | (NH2-C6)s(invAb)saaugaagaAfAfGfuacaaagacas(invAb) | 941 | AAUGAAGAAAGUACAAAGACA | 1207 |
| AM13397-SS | (invAb)scauuuuaaUfCfCfucacuC16cuaaas(invAb) | 942 | CAUUUUAAUCCUCACUCUAAA | 1202 |
| AM14674-SS | (NAG37)s(invAb)succucacuCfUfAfagaaacaugas(invAb) | 943 | UCCUCACUCUAAGAAACAUGA | 1204 |
| AM16529-SS | (invAb)scauuuuaaUfCfCfucacucuaaas(invAb) | 944 | CAUUUUAAUCCUCACUCUAAA | 1202 |
| AM14511-SS | (NH2-C6)s(invAb)scccucaaaCfCfAfuuaaacuguas(invAb) | 945 | CCCUCAAACCAUUAAACUGUA | 1206 |
| AM14505-SS | (NH2-C6)s(invAb)sagguggaaAfUfGfaagaaaguaas(invAb) | 946 | AGGUGGAAAUGAAGAAAGUAA | 1193 |
| AM14515-SS | (NH2-C6)s(invAb)sacuguaauCfUfGfaagaguugas(invAb) | 947 | ACUGUAAUCUGAAGAGUUGA | 1208 |
| AM14678-SS | (NAG37)s(invAb)saaugaagaAfAfGfuacaaagacas(invAb) | 948 | AAUGAAGAAAGUACAAAGACA | 1207 |
| AM14503-SS | (NH2-C6)s(invAb)sguccaugaGfAfAfacaagaugaas(invAb) | 949 | GUCCAUGAGAAACAAGAUGAA | 1203 |
| AM14675-SS | (NAG37)s(invAb)scaggagagCfAfUfuccaucauuas(invAb) | 950 | CAGGAGAGCAUUCCAUCAUUA | 1209 |
| AM13977-SS | (invAb)scauuuuaaUfCfCfuCfaCfuCfuAfaas(invAb)s(C6-NH2) | 951 | CAUUUUAAUCCUCACUCUAAA | 1202 |
| AM15561-SS | (NH2-C6)s(invAb)scauuuuaaUfCfCfucacucua_2Naas(invAb) | 952 | CAUUUUAAUCCUCACUCU(A$^{2N}$)AA | 1225 |
| AM15559-SS | (NH2-C6)s(invAb)scauuuuaaUfCfCfucacucuaaa_2Ns(invAb) | 953 | CAUUUUAAUCCUCACUCUAA(A$^{2N}$) | 1226 |
| AM13588-SS | (NH2-C6)scauuuuaaUfCfCfucacucuaaa(invAb) | 954 | CAUUUUAAUCCUCACUCUAAA | 1202 |
| AM14518-SS | (NH2-C6)s(invAb)scauuuuaaUfCfCfucacucuaaa(invAb) | 955 | CAUUUUAAUCCUCACUCUAAA | 1202 |
| AM15562-SS | (NH2-C6)s(invAb)scauuuuaaUfCfCfucacucuALNAaas(invAb) | 956 | CAUUUUAAUCCUCACUCUAAA | 1202 |
| AM16134-SS | (NH2-C6)s(invAb)scauuuuaaUfCfCfucacucuaaas(invAb)s(C6-NH2) | 957 | CAUUUUAAUCCUCACUCUAAA | 1202 |
| AM15554-SS | (NH2-C6)s(invAb)scauuuuaaUfCfCfucacucuaaas(invAb)s(C6-SS-C6)dT | 958 | CAUUUUAAUCCUCACUCUAAAT | 1213 |
| AM14682-SS | (NAG37)s(invAb)sacuguaauCfUfGfaagaguugas(invAb) | 959 | ACUGUAAUCUGAAGAGUUGA | 1208 |
| AM13395-SS | (invAb)scauC16uuuaaUfCfCfucacucuaaas(invAb) | 960 | CAUUUUAAUCCUCACUCUAAA | 1202 |
| AM15555-SS | (NH2-C6)(invAb)scsauuuuaaUfCfCfucacucuaaas(invAb)s(C6-CSS-6)dT | 961 | CAUUUUAAUCCUCACUCUAAAT | 1213 |
| AM15043-SS | (NH2-C6)s(invAb)scauuuC16aaUfCfCfucacucuaaas(invAb) | 962 | CAUUUUAAUCCUCACUCUAAA | 1202 |
| AM13768-SS | (NH2-C6)s(invAb)scauuuuaaUfCfCfuAlkcacucuaaas(invAb)(C6-SS-C6)dT | 963 | CAUUUUAAUCCUCACUCUAAAT | 1213 |
| AM14681-SS | (NAG37)s(invAb)saaccauuaAfAfCfuguaaucugas(invAb) | 964 | AACCAUUAAACUGUAAUCUGA | 1210 |
| AM12558-SS | (NAG37)s(invAb)scauuuuaaUfCfCfucacucuaaas(invAb) | 965 | CAUUUUAAUCCUCACUCUAAA | 1202 |
| AM16524-SS | (invAb)scauuuuaaUfCfCfucacucuaaas(invAb) | 966 | CAUUUUAAUCCUCACUCUAAA | 1202 |
| AM14497-SS | (NH2-C6)s(invAb)scaggaccuCfAfUfuuuaauccuas(invAb) | 967 | CAGGACCUCAUUUUAAUCCUA | 1211 |
| AM13975-SS | (invAb)scauuuuaaUfCfCfucacucuaaas(invAb)s(C6-NH2) | 968 | CAUUUUAAUCCUCACUCUAAA | 1202 |
| AM14509-SS | (NH2-C6)s(invAb)sacucaucuGfCfUfacccucaaaas(invAb) | 969 | ACUCAUCUGCUACCCUCAAAA | 1205 |
| AM16903-SS | (NH2-C6)s(invAb)scauuuuAfaUfCfCfucacucuaaas(invAb) | 970 | CAUUUUAAUCCUCACUCUAAA | 1202 |
| AM16525-SS | (NAG37)s(invAb)scauuuC16aaUfCfCfucacucuaaas(invAb) | 971 | CAUUUUAAUCCUCACUCUAAA | 1202 |
| AM15560-SS | (NH2-C6)s(invAb)scauuuuaaUfCfCfucacucuaa_2Nas(invAb) | 972 | CAUUUUAAUCCUCACUCUA(A$^{2N}$)A | 1227 |

TABLE 5-continued

SOD1 Agent Sense Strand Sequences (Shown With (NH2-C6) Linker, (NAG37)s ligand, or (invAb) end cap (see Table 11 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM14513-SS | (NH2-C6)s(invAb)saaccauuaAfAfCfuguaaucugas(invAb) | 973 | AACCAUUAAACUGUAAUCUGA | 1210 |
| AM14673-SS | (NAG37)s(invAb)scaggaccuCfAfUfuuuaauccuas(invAb) | 974 | CAGGACCUCAUUUUAAUCCUA | 1211 |
| AM14501-SS | (NH2-C6)s(invAb)scaggagagCfAfUfuccaucauuas(invAb) | 975 | CAGGAGAGCAUUCCAUCAUUA | 1209 |
| AM13396-SS | (invAb)scauuuuC16aaUfCfCfucacucuaaas(invAb) | 976 | CAUUUUAAUCCUCACUCUAAA | 1202 |
| AM17382-SS | (NH2-C6)s(invAb)sguugaagaUfuCfuGfugaucucas(invAb) | 977 | GUUGAAGAUUCUGUGAUCUCA | 1172 |

TABLE 6

SOD1 Agent Sense Strand Sequences (Shown with lipid moiety.) The structures of the lipid moieties are shown in Table 11.

| Strand ID | Modified Sense Strand (5' → 3') | SEQ ID NO. | Corresponding Sense Strand AM Number Without Linker or Conjugate (See Table 4) |
|---|---|---|---|
| CS001845 | LP183-(NH-C6)s(invAb)sgaaaguaaUfGfGfaccagugaaas(invAb) | 978 | AM13283-SS |
| CS001847 | LP183-(NH-C6)s(invAb)sgccugcauGfGfAfuuccauguuas(invAb) | 979 | AM13285-SS |
| CS001849 | LP183-(NH-C6)s(invAb)sauuccaugUfUfCfaugaguuugas(invAb) | 980 | AM13287-SS |
| CS001851 | LP183-(NH-C6)s(invAb)sugcaggucCfUfCfacuuuaaucas(invAb) | 981 | AM13289-SS |
| CS001853 | LP183-(NH-C6)s(invAb)sccucacuuUfAfAfuccucuaucas(invAb) | 982 | AM13291-SS |
| CS001855 | LP183-(NH-C6)s(invAb)saggaugaaGfAfGfaggcauguuas(invAb) | 983 | AM13293-SS |
| CS001857 | LP183-(NH-C6)s(invAb)scuauugaaGfAfUfucugugaucus(invAb) | 984 | AM13295-SS |
| CS001859 | LP183-(NH-C6)s(invAb)suuggcuugUfGfGfuguaauuggas(invAb) | 985 | AM13297-SS |
| CS001861 | LP183-(NH-C6)s(invAb)sua_2NaacauuCfCfCfuuggauguaas(invAb) | 986 | AM13299-SS |
| CS001863 | LP183-(NH-C6)s(invAb)scauucccuUfGfGfauguagucuas(invAb) | 987 | AM13301-SS |
| CS001865 | LP183-(NH-C6)s(invAb)scuuaacucAfUfCfuguuauccuas(invAb) | 988 | AM13303-SS |
| CS001867 | LP183-(NH-C6)s(invAb)sguuauccuGfCfUfagcuguagaas(invAb) | 989 | AM13305-SS |
| CS001869 | LP183-(NH-C6)s(invAb)sgcuagcugUfAfGfaaauguacas(invAb) | 990 | AM13307-SS |
| CS001871 | LP183-(NH-C6)s(invAb)suagcuguaGfAfAfauguauccuas(invAb) | 991 | AM13309-SS |
| CS001873 | LP183-(NH-C6)s(invAb)sgaaauguaUfCfCfugauaaacaus(invAb) | 992 | AM13311-SS |
| CS001875 | LP183-(NH-C6)s(invAb)succugauaAfAfCfauuaaacacus(invAb) | 993 | AM13313-SS |
| CS001877 | LP183-(NH-C6)s(invAb)sa_2NaacauuaAfAfCfacuguaaucus(invAb) | 994 | AM13315-SS |
| CS001879 | LP183-(NH-C6)s(invAb)sugcuuuaaAfGfUfaccuguaguas(invAb) | 995 | AM13317-SS |
| CS001881 | LP183-(NH-C6)s(invAb)saaacugauUfUfAfugaucacuuas(invAb) | 996 | AM13319-SS |
| CS001883 | LP183-(NH-C6)s(invAb)scuuggaagAfUfUfuguauaguuus(invAb) | 997 | AM13321-SS |
| CS001885 | LP183-(NH-C6)s(invAb)scuguuucaAfUfGfaccuguauuus(invAb) | 998 | AM13323-SS |
| CS001887 | LP183-(NH-C6)s(invAb)suuuaaaucaCfAfGffauggguauuas(invAb) | 999 | AM13325-SS |
| CS001889 | LP183-(NH-C6)s(invAb)sa_2NgaugggUAfUfUfaaacuugucas(invAb) | 1000 | AM13327-SS |

TABLE 6-continued

SOD1 Agent Sense Strand Sequences (Shown with lipid moiety.) The structures of the lipid moieties are shown in Table 11.

| Strand ID | Mod

TABLE 6-continued

SOD1 Agent Sense Strand Sequences (Shown with lipid moiety.) The structures of the lipid moieties are shown in Table 11.

| Strand ID | Modified Sense Strand (5' → 3') | SEQ ID NO. | Corresponding Sense Strand AM Number Without Linker or Conjugate (See Table 4) |
|---|---|---|---|
| CS003258 | LP395-(NH-C6)s(invAb)sccucacuuUfAfAfuccucuaucas(invAb) | 1035 | AM13291-SS |
| CS913315 | LP293-(NH-C6)s(invAb)sguugaagaUfuCfuGfugaucucas(invAb) | 1036 | AM17382-SS |

TABLE 6a

SOD1 Agent Sense Strand Sequences (Shown with lipid moiety.) The structures of the lipid moieties are shown in Table 11.

| Strand ID | Modified Sense Strand (5' → 3') | SEQ ID NO. | | SEQ ID NO. |
|---|---|---|---|---|
| AM15752-SS | LP183-(NH-C6)s(invAb)sccucAfcuuUfAfAfUfccucuaucas(invAb) | 1037 | CCUCACUUUAAUCCUCUAUCA | 1151 |
| AM15931-SS | LP183-(NH-C6)s(invAb)sccucacuuUfAfAfuccucuaucas(invAb) | 1038 | CCUCACUUUAAUCCUCUAUCA | 1151 |
| AM16118-SS | LP183-(NH-C6)s(invAb)sca_2NugaaaaAfGfCfagaugacuuus(invAb) | 1039 | CAUGAAAAGCAGAUGACUUU | 1173 |
| AM16119-SS | LP183-(NH-C6)s(invAb)scuuaacucAfUfCfuguuauccuas(invAb) | 1040 | CUUAACUCAUCUGUUAUCCUA | 1157 |
| AM16120-SS | LP183-(NH-C6)s(invAb)sguuauccuGfCfUfagcuguagaas(invAb) | 1041 | GUUAUCCUGCUAGCUGUAGAA | 1158 |
| AM16121-SS | LP183-(NH-C6)s(invAb)succugauaAfAfCfauuaaacacus(invAb) | 1042 | UCCUGAUAAACAUUAAACACU | 1162 |
| AM16168-SS | LP183-(NH-C6)s(invAb)sguugaagaUfuCfUfCfugugaucucas(invAb) | 1043 | GUUGAAGAUUCUGUGAUCUCA | 1172 |
| AM16170-SS | LP183-(NH-C6)s(invAb)sccuuaacuCfAfUfcuguuauccas(invAb) | 1044 | CCUUAACUCAUCUGUUAUCCA | 1183 |
| AM16172-SS | LP183-(NH-C6)s(invAb)scucaucugUfUfAfuccugcuagas(invAb) | 1045 | CUCAUCUGUUAUCCUGCUAGA | 1184 |
| AM16174-SS | LP183-(NH-C6)s(invAb)scugcuagcUfGfUfagaaauguaas(invAb) | 1046 | CUGCUAGCUGUAGAAAUGUAA | 1185 |
| AM16176-SS | LP183-(NH-C6)s(invAb)scccugauaAfAfCfauuaaacacas(invAb) | 1047 | CCCUGAUAAACAUUAAACACA | 1186 |
| AM16178-SS | LP183-(NH-C6)s(invAb)sgca_2NuuaaaCfAfCfuguaaucuuas(invAb) | 1048 | GCAUUAAACACUGUAAUCUUA | 1187 |
| AM16180-SS | LP183-(NH-C6)s(invAb)scua_2NugaucAfCfUfuggaagauuas(invAb) | 1049 | CUAUGAUCACUUGGAAGAUUA | 1188 |
| AM16182-SS | LP183-(NH-C6)s(invAb)sgaccuguaUfUfUfugccagacuas(invAb) | 1050 | GACCUGUAUUUUGCCAGACUA | 1189 |
| AM16237-SS | LP183-(NH-C6)s(invAb)scugcauggAfUfUfccauguucaus(invAb) | 1051 | CUGCAUGGAUUCCAUGUUCAU | 1190 |
| AM16239-SS | LP183-(NH-C6)s(invAb)sacuggugGfUfCfcaugaaaaagas(invAb) | 1052 | ACUGGUGGUCCAUGAAAAAGA | 1191 |
| AM16241-SS | LP183-(NH-C6)s(invAb)sccaugaaaAfAfGfcagaugacuus(invAb) | 1053 | CCAUGAAAAGCAGAUGACUU | 1192 |
| AM16243-SS | LP183-(NH-C6)s(invAb)sagguggaaAfUfGfaagaaaguaas(invAb) | 1054 | AGGUGGAAAUGAAGAAAGUAA | 1193 |
| AM16245-SS | LP183-(NH-C6)s(invAb)sccccuuaacUfCfAfucucguuaucas(invAb) | 1055 | CCCUUAACUCAUCUGUUAUCA | 1194 |
| AM16247-SS | LP183-(NH-C6)s(invAb)scua_2NacucaUfCfUfguuauccugas(invAb) | 1056 | CUAACUCAUCUGUUAUCCUGA | 1195 |
| AM16249-SS | LP183-(NH-C6)s(invAb)scaucuguuAfUfCfcugcuaguuas(invAb) | 1057 | CAUCUGUUAUCCUGCUAGUUA | 1196 |
| AM16251-SS | LP183-(NH-C6)s(invAb)sccugcuagCfUfGfuagaaauguas(invAb) | 1058 | CCUGCUAGCUGUAGAAAUGUA | 1197 |
| AM16253-SS | LP183-(NH-C6)s(invAb)scaguuaaaAfUfGfucuguuucaas(invAb) | 1059 | CAGUUAAAAUGUCUGUUUCAA | 1198 |
| AM16255-SS | LP183-(NH-C6)s(invAb)sga_2NaugucuGfUfUfucaaugacuus(invAb) | 1060 | GAAUGUCUGUUUCAAUGACUU | 1199 |
| AM16257-SS | LP183-(NH-C6)s(invAb)scacagaugGfGfUfauuaaacuuas(invAb) | 1061 | CACAGAUGGGUAUUAAACUUA | 1200 |

TABLE 6a-continued

SOD1 Agent Sense Strand Sequences (Shown with lipid moiety.) The structures of the lipid moieties are shown in Table 11.

| Strand ID | Modified Sense Strand (5' → 3') | SEQ ID NO. | | SEQ ID NO. |
|---|---|---|---|---|
| AM16259-SS | LP183-(NH-C6)s(invAb)sgcagauggGfUfAfuuaaacuugus(invAb) | 1062 | GCAGAUGGGUAUUAAACUUGU | 1201 |
| AM16616-SS | LP183rs(invAb)scuuaacucAfUfCfuguuauccuas(invAb) | 1063 | CUUAACUCAUCUGUUAUCCUA | 1157 |
| AM16617-SS | LP183rs(invAb)sccucacuuUfAfAfuccucuaucas(invAb) | 1064 | CCUCACUUUAAUCCUCUAUCA | 1151 |
| AM16618-SS | LP183-(NH-C6)s(invAb)sca_2NugaaaaAfGfCfagaugacuuus(invAb) | 1065 | CAUGAAAAGCAGAUGACUUU | 1173 |
| AM16619-SS | LP183-(NH-C6)s(invAb)sucacagauGfGfGfuauuaaacuus(invAb) | 1066 | UCACAGAUGGGUAUUAAACUU | 1176 |
| AM16672-SS | LP409-(NH-C6)s(invAb)sccucacuuUfAfAfuccucuaucas(invAb) | 1067 | CCUCACUUUAAUCCUCUAUCA | 1151 |
| AM16688-SS | LP395-(NH-C6)s(invAb)sccucacuuUfAfAfuccucuaucas(invAb) | 1068 | CCUCACUUUAAUCCUCUAUCA | 1151 |
| AM16705-SS | LP183-(NH-C6)s(invAb)sccucacuuUfAfAfuccucuaucas(invAb) | 1069 | CCUCACUUUAAUCCUCUAUCA | 1151 |
| AM16706-SS | C22s(invAb)sccucacuuUfAfAfuccucuaucas(invAb) | 1070 | CCUCACUUUAAUCCUCUAUCA | 1151 |
| AM16800-SS | HO-C16s(invAb)sccucacuuUfAfAfuccucuaucas(invAb) | 1071 | CCUCACUUUAAUCCUCUAUCA | 1151 |
| AM16814-SS | (2C8C12)s(invAb)sccucacuuUfAfAfuccucuaucas(invAb) | 1072 | CCUCACUUUAAUCCUCUAUCA | 1151 |
| AM16815-SS | (2C6C10)s(invAb)sccucacuuUfAfAfuccucuaucas(invAb) | 1073 | CCUCACUUUAAUCCUCUAUCA | 1151 |
| AM16949-SS | LP183-(NH-C6)s(invAb)sguugaagaUfUfCfugugaucucas(invAb) | 1074 | GUUGAAGAUUCUGUGAUCUCA | 1172 |
| AM16954-SS | LP183-(NH-C6)s(invAb)sguugaagaUfuCfuGfugaucucas(invAb) | 1075 | GUUGAAGAUUCUGUGAUCUCA | 1172 |
| AM16529-SS | LP183rs(invAb)scauuuuaaUfCfCfucacucuaaas(invAb) | 1076 | CAUUUUAAUCCUCACUCUAAA | 1202 |
| AM16134-SS | LP183-(NH-C6)s(invAb)scauuuuaaUfCfCfucacucuaaas(invAb)s(C6-NH2) | 1077 | CAUUUUAAUCCUCACUCUAAA | 1202 |
| AM16903-SS | LP183-(NH-C6)s(invAb)scauuuuAfaUfCfCfucacucuaaas(invAb) | 1078 | CAUUUUAAUCCUCACUCUAAA | 1202 |
| AM17382-SS | LP293-(NH-C6)s(invAb)sguugaagaUfuCfuGfugaucucas(invAb) | 1079 | GUUGAAGAUUCUGUGAUCUCA | 1172 |

The SOD1 RNAi agents disclosed herein are formed by annealing an antisense strand with a sense strand. A sense strand containing a sequence listed in Table 2, Table 4, Table 5, Table 6, or Table 6a can be hybridized to any antisense strand containing a sequence listed in Table 2 or Table 3, provided the two sequences have a region of at least 85% complementarity over a contiguous 16, 17, 18, 19, 20, or 21 nucleotide sequence.

As shown in Table 5 above, certain of the example SOD1 RNAi agent nucleotide sequences are shown to further include reactive linking groups at one or both of the 5' terminal end and the 3' terminal end of the sense strand. For example, many of the SOD1 RNAi agent sense strand sequences shown in Table 5 above have a (NH2-C6) linking group at the 5' end of the nucleotide sequence. Other linking groups, such as a (6-SS-6) linking group or a (C6-SS—C6) linking group, may be present as well or alternatively in certain embodiments. Such reactive linking groups are positioned to facilitate the linking of targeting ligands, targeting groups, and/or PKIPD modulators to the SOD1 RNAi agents disclosed herein. Linking or conjugation reactions are well known in the art and provide for formation of covalent linkages between two molecules or reactants. Suitable conjugation reactions for use in the scope of the inventions herein include, but are not limited to, amide coupling reaction, Michael addition reaction, hydrazone formation reaction, inverse-demand Diels-Alder cycloaddition reaction, oxime ligation, and Copper (I)-catalyzed or strain-promoted azide-alkyne cycloaddition reaction cycloaddition reaction.

In some embodiments, targeting ligands, can be synthesized as activated esters, such as tetrafluorophenyl (TFP) esters, which can be displaced by a reactive amino group (e.g., $NH_2$—$C_6$) to attach the targeting ligand to the SOD1 RNAi agents disclosed herein. In some embodiments, targeting ligands are synthesized as azides, which can be conjugated to a propargyl or DBCO group, for example, via Copper (I)-catalyzed or strain-promoted azide-alkyne cycloaddition reaction.

Additionally, certain of the nucleotide sequences can be synthesized with a dT nucleotide at the 3' terminal end of the sense strand, followed by (3'→5') a linker (e.g., C6-SS—C6). The linker can, in some embodiments, facilitate the linkage to additional components, such as, for example, a lipid or one or more targeting ligands. As described herein, the disulfide bond of C6-SS—C6 is first reduced, removing the dT from the molecule, which can then facilitate the conjugation of the desired component. The terminal dT nucleotide therefore is not a part of the fully conjugated construct.

In some embodiments, the antisense strand of a SOD1 RNAi agent disclosed herein differs by 0, 1, 2, or 3 nucleotides from any of the antisense strand sequences in Table 3 or Table 10. In some embodiments, the sense strand of a SOD1 RNAi agent disclosed herein differs by 0, 1, 2, or 3 nucleotides from any of the sense strand sequences in Table 4, Table 5, Table 6, Table 6a, or Table 10.

In some embodiments, a SOD1 RNAi agent antisense strand comprises a nucleotide sequence of any of the sequences in Table 2 or Table 3. In some embodiments, a SOD1 RNAi agent antisense strand comprises the sequence of nucleotides (from 5' end→3' end) 1-17, 2-17, 1-18, 2-18, 1-19, 2-19, 1-20, 2-20, 1-21, 2-21, 1-22, 2-22, 1-23, 2-23, 1-24, or 2-24 of any of the sequences in Table 2, Table 3, or Table 10. In certain embodiments, a SOD1 RNAi agent antisense strand comprises or consists of a modified sequence of any one of the modified sequences in Table 3 or Table 10.

In some embodiments, a SOD1 RNAi agent sense strand comprises the nucleotide sequence of any of the sequences in Table 2 or Table 4. In some embodiments, a SOD1 RNAi agent sense strand comprises the sequence of nucleotides (from 5' end→3' end) 1-17, 2-17, 3-17, 4-17, 1-18, 2-18, 3-18, 4-18, 1-19, 2-19, 3-19, 4-19, 1-20, 2-20, 3-20, 4-20, 1-21, 2-21, 3-21, 4-21, 1-22, 2-22, 3-22, 4-22, 1-23, 2-23, 3-23, 4-23, 1-24, 2-24, 3-24, or 4-24, of any of the sequences in Table 2, Table 4, Table 5, Table 6, Table 6a or Table 10. In certain embodiments, a SOD1 RNAi agent sense strand comprises or consists of a modified sequence of any one of the modified sequences in Table 3 or Table 10.

For the RNAi agents disclosed herein, the nucleotide at position 1 of the antisense strand (from 5' end→3' end) can be perfectly complementary to a SOD1 gene, or can be non-complementary to a SOD1 gene. In some embodiments, the nucleotide at position 1 of the antisense strand (from 5' end→3' end) is a U, A, or dT (or a modified version of U, A or dT). In some embodiments, the nucleotide at position 1 of the antisense strand (from 5' end→3' end) forms an A:U or U:A base pair with the sense strand.

In some embodiments, a SOD1 RNAi agent antisense strand comprises the sequence of nucleotides (from 5' end→3' end) 2-18 or 2-19 of any of the antisense strand sequences in Table 2, Table 3, or Table 10. In some embodiments, a SOD1 RNAi sense strand comprises the sequence of nucleotides (from 5' end→3' end) 1-17 or 1-18 of any of the sense strand sequences in Table 2, Table 4, Table 5, Table 6, Table 6a or Table 10.

In some embodiments, a SOD1 RNAi agent includes (i) an antisense strand comprising the sequence of nucleotides (from 5' end→3' end) 2-18 or 2-19 of any of the antisense strand sequences in Table 2, Table 3, or Table 10, and (ii) a sense strand comprising the sequence of nucleotides (from 5' end→3' end) 1-17 or 1-18 of any of the sense strand sequences in Table 2, Table 4, Table 5, Table 6, Table 6a or Table 10.

A sense strand containing a sequence listed in Table 2 or Table 4 can be hybridized to any antisense strand containing a sequence listed in Table 2 or Table 3 provided the two sequences have a region of at least 85% complementarity over a contiguous 16, 17, 18, 19, 20, or 21 nucleotide sequence. In some embodiments, the SOD1 RNAi agent has a sense strand consisting of the modified sequence of any of the modified sequences in Table 4, Table 5, Table 6, Table 6a, or Table 10, and an antisense strand consisting of the modified sequence of any of the modified sequences in Table 3 or Table 10. Certain representative sequence pairings are exemplified by the Duplex ID Nos. shown in Tables 7A, 7B, 8, and 9A.

In some embodiments, a SOD1 RNAi agent comprises, consists of, or consists essentially of a duplex represented by any one of the Duplex ID Nos. presented herein. In some embodiments, a SOD1 RNAi agent consists of any of the Duplex ID Nos. presented herein. In some embodiments, a SOD1 RNAi agent comprises the sense strand and antisense strand nucleotide sequences of any of the Duplex ID Nos. presented herein. In some embodiments, a SOD1 RNAi agent comprises the sense strand and antisense strand nucleotide sequences of any of the Duplex ID Nos. presented herein and a targeting group, linking group, PK/PD modulator and/or other non-nucleotide group wherein the targeting group, linking group, PK/PD modulator and/or other non-nucleotide group is covalently linked (i.e., conjugated) to the sense strand or the antisense strand. In some embodiments, a SOD1 RNAi agent includes the sense strand and antisense strand modified nucleotide sequences of any of the Duplex ID Nos. presented herein. In some embodiments, a SOD1 RNAi agent comprises the sense strand and antisense strand modified nucleotide sequences of any of the Duplex ID Nos. presented herein and a targeting group, linking group, and/or other non-nucleotide group, wherein the targeting group, linking group, PK/PD modulator and/or other non-nucleotide group is covalently linked to the sense strand or the antisense strand.

In some embodiments, a SOD1 RNAi agent comprises an antisense strand and a sense strand having the nucleotide sequences of any of the antisense strand/sense strand duplexes of Tables 2, 7A, 7B, 8, 9A, or 10, and comprises a PK/PD modulator. In some embodiments, a SOD1 RNAi agent comprises an antisense strand and a sense strand having the nucleotide sequences of any of the antisense strand/sense strand duplexes of Tables 2, 7A, 7B, 8, 9A, or 10, and comprises one or more lipid moieties.

In some embodiments, a SOD1 RNAi agent comprises an antisense strand and a sense strand having the nucleotide sequences of any of the antisense strand/sense strand duplexes of Tables 2, 7A, 7B, 8, 9A, or 10, and comprises a lipid moiety. In some embodiments, a SOD1 RNAi agent comprises an antisense strand and a sense strand having the nucleotide sequences of any of the antisense strand/sense strand duplexes of Tables 2, 7A, 7B, 8, 9A, or 10, and comprises one or more lipid moieties.

In some embodiments, a SOD1 RNAi agent comprises an antisense strand and a sense strand having the modified nucleotide sequences of any of the antisense strand/sense strand duplexes of Tables 7A, 7B, 8, 9A, and 10.

In some embodiments, a SOD1 RNAi agent comprises an antisense strand and a sense strand having the modified nucleotide sequences of any of the antisense strand/sense strand duplexes of Tables 7A, 7B, 8, 9A, and 10, and comprises a lipid moiety.

In some embodiments, a SOD1 RNAi agent comprises, consists of, or consists essentially of any of the duplexes of Tables 7A, 7B, 8, 9A, and 10.

TABLE 7A

SOD1 RNAi Agent Duplexes with Corresponding Sense and Antisense Strand ID Numbers and Sequence ID numbers for the modified and unmodified nucleotide sequences. (Shown without Linking Agents or Conjugates)

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD09381 | AM13284-AS | 522 | 1080 | AM13283-SS | 681 | 1147 |
| AD09382 | AM13286-AS | 523 | 1081 | AM13285-SS | 682 | 1148 |
| AD09383 | AM13288-AS | 524 | 1082 | AM13287-SS | 683 | 1149 |
| AD09384 | AM13290-AS | 525 | 1083 | AM13289-SS | 684 | 1150 |
| AD09385 | AM13292-AS | 526 | 1084 | AM13291-SS | 685 | 1151 |
| AD09386 | AM13294-AS | 527 | 1085 | AM13293-SS | 686 | 1152 |
| AD09387 | AM13296-AS | 528 | 1086 | AM13295-SS | 687 | 1153 |
| AD09388 | AM13298-AS | 529 | 1087 | AM13297-SS | 688 | 1154 |
| AD09389 | AM13300-AS | 530 | 1088 | AM13299-SS | 689 | 1155 |
| AD09390 | AM13302-AS | 531 | 1089 | AM13301-SS | 690 | 1156 |
| AD09391 | AM13304-AS | 532 | 1090 | AM13303-SS | 691 | 1157 |
| AD09392 | AM13306-AS | 533 | 1091 | AM13305-SS | 692 | 1158 |
| AD09393 | AM13308-AS | 534 | 1092 | AM13307-SS | 693 | 1159 |
| AD09394 | AM13310-AS | 535 | 1093 | AM13309-SS | 694 | 1160 |
| AD09395 | AM13312-AS | 536 | 1094 | AM13311-SS | 685 | 1161 |
| AD09396 | AM13314-AS | 537 | 1095 | AM13313-SS | 696 | 1162 |
| AD09397 | AM13316-AS | 538 | 1096 | AM13315-SS | 697 | 1163 |
| AD09398 | AM13318-AS | 539 | 1097 | AM13317-SS | 698 | 1164 |
| AD09399 | AM13320-AS | 540 | 1098 | AM13319-SS | 699 | 1165 |
| AD09400 | AM13322-AS | 541 | 1099 | AM13321-SS | 700 | 1166 |
| AD09401 | AM13324-AS | 542 | 1100 | AM13323-SS | 701 | 1167 |
| AD09402 | AM13326-AS | 543 | 1101 | AM13325-SS | 702 | 1168 |
| AD09403 | AM13328-AS | 544 | 1102 | AM13327-SS | 703 | 1169 |
| AD09754 | AM13918-AS | 545 | 1103 | AM13917-SS | 704 | 1170 |
| AD09755 | AM13920-AS | 546 | 1104 | AM13919-SS | 705 | 1171 |
| AD09756 | AM13922-AS | 547 | 1105 | AM13921-SS | 706 | 1172 |
| AD09757 | AM13924-AS | 548 | 1106 | AM13923-SS | 707 | 1173 |
| AD09758 | AM13926-AS | 549 | 1107 | AM13925-SS | 708 | 1174 |
| AD09759 | AM13928-AS | 550 | 1108 | AM13927-SS | 709 | 1175 |
| AD09760 | AM13930-AS | 551 | 1109 | AM13929-SS | 710 | 1176 |
| AD09798 | AM13292-AS | 526 | 1084 | AM13988-SS | 711 | 1151 |
| AD09806 | AM13918-AS | 545 | 1103 | AM13997-SS | 712 | 1170 |
| AD09807 | AM13920-AS | 546 | 1104 | AM13998-SS | 713 | 1171 |
| AD09808 | AM13922-AS | 547 | 1105 | AM13999-SS | 714 | 1172 |
| AD09809 | AM13924-AS | 548 | 1106 | AM14000-SS | 715 | 1173 |
| AD09810 | AM13926-AS | 549 | 1107 | AM14001-SS | 716 | 1174 |
| AD09811 | AM13928-AS | 550 | 1108 | AM14002-SS | 717 | 1175 |
| AD09812 | AM13930-AS | 551 | 1109 | AM14003-SS | 718 | 1176 |
| AD09813 | AM13312-AS | 536 | 1094 | AM14004-SS | 719 | 1161 |
| AD09825 | AM14017-AS | 552 | 1084 | AM13988-SS | 711 | 1151 |
| AD09826 | AM14019-AS | 553 | 1110 | AM14018-SS | 720 | 1177 |
| AD09827 | AM14020-AS | 554 | 1110 | AM14018-SS | 780 | 1177 |
| AD09828 | AM14021-AS | 555 | 1084 | AM13988-SS | 711 | 1151 |
| AD09829 | AM14022-AS | 556 | 1084 | AM13988-SS | 711 | 1151 |
| AD09830 | AM14023-AS | 557 | 1084 | AM13988-SS | 711 | 1151 |
| AD09831 | AM14024-AS | 558 | 1084 | AM13988-SS | 711 | 1151 |
| AD09832 | AM14026-AS | 559 | 1111 | AM14025-SS | 721 | 1178 |
| AD09869 | AM13304-AS | 532 | 1090 | AM14089-SS | 722 | 1157 |
| AD09878 | AM14096-AS | 560 | 1090 | AM14089-SS | 722 | 1157 |
| AD09879 | AM14097-AS | 561 | 1090 | AM14089-SS | 722 | 1157 |
| AD09880 | AM14098-AS | 562 | 1090 | AM14089-SS | 722 | 1157 |
| AD09881 | AM14099-AS | 563 | 1090 | AM14089-SS | 722 | 1157 |
| AD09882 | AM14100-AS | 564 | 1090 | AM14089-SS | 722 | 1157 |
| AD09883 | AM14102-AS | 565 | 1112 | AM14101-SS | 723 | 1179 |
| AD09884 | AM14103-AS | 566 | 1090 | AM14089-SS | 722 | 1157 |
| AD09885 | AM14104-AS | 567 | 1090 | AM14089-SS | 722 | 1157 |
| AD09886 | AM14106-AS | 568 | 1113 | AM14105-SS | 724 | 1180 |
| AD10001 | AM14270-AS | 569 | 1111 | AM14025-SS | 721 | 1178 |
| AD10002 | AM14271-AS | 570 | 1111 | AM14025-SS | 721 | 1178 |
| AD10003 | AM14272-AS | 571 | 1111 | AM14025-SS | 721 | 1178 |
| AD10004 | AM14273-AS | 572 | 1111 | AM14025-SS | 721 | 1178 |
| AD10006 | AM14277-AS | 573 | 1084 | AM14276-SS | 864 | 1151 |
| AD10007 | AM14279-AS | 574 | 1090 | AM14278-SS | 865 | 1157 |
| AD10055 | AM14020-AS | 554 | 1110 | AM14334-SS | 725 | 1177 |
| AD10056 | AM14021-AS | 555 | 1084 | AM13291-SS | 685 | 1151 |
| AD10057 | AM14022-AS | 556 | 1084 | AM13291-SS | 685 | 1151 |
| AD10058 | AM14023-AS | 557 | 1084 | AM13291-SS | 685 | 1151 |
| AD10059 | AM14024-AS | 558 | 1084 | AM13291-SS | 685 | 1151 |
| AD10060 | AM14335-AS | 575 | 1084 | AM13988-SS | 711 | 1151 |
| AD10061 | AM14335-AS | 575 | 1084 | AM13291-SS | 685 | 1151 |
| AD10066 | AM14339-AS | 576 | 1084 | AM13291-SS | 685 | 1151 |
| AD10067 | AM14339-AS | 576 | 1084 | AM14340-SS | 726 | 1181 |

TABLE 7A-continued

SOD1 RNAi Agent Duplexes with Corresponding Sense
and Antisense Strand ID Numbers and Sequence ID numbers for the modified
and unmodified nucleotide sequences. (Shown without Linking Agents or Conjugates)

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD10068 | AM14341-AS | 577 | 1084 | AM13291-SS | 685 | 1151 |
| AD10069 | AM14342-AS | 578 | 1084 | AM13291-SS | 685 | 1151 |
| AD10070 | AM14343-AS | 579 | 1084 | AM13291-SS | 685 | 1151 |
| AD10071 | AM14344-AS | 580 | 1084 | AM13291-SS | 685 | 1151 |
| AD10072 | AM14345-AS | 581 | 1084 | AM13291-SS | 685 | 1151 |
| AD10073 | AM14347-AS | 582 | 1111 | AM14346-SS | 727 | 1178 |
| AD10077 | AM14365-AS | 583 | 1090 | AM13303-SS | 691 | 1157 |
| AD10078 | AM14366-AS | 584 | 1090 | AM13303-SS | 691 | 1157 |
| AD10079 | AM14367-AS | 585 | 1090 | AM13303-SS | 691 | 1157 |
| AD10080 | AM14368-AS | 586 | 1090 | AM13303-SS | 691 | 1157 |
| AD10081 | AM14369-AS | 587 | 1090 | AM13303-SS | 691 | 1157 |
| AD10082 | AM14370-AS | 588 | 1090 | AM13303-SS | 691 | 1157 |
| AD10083 | AM14371-AS | 589 | 1090 | AM13303-SS | 691 | 1157 |
| AD10084 | AM14373-AS | 590 | 1113 | AM14372-SS | 728 | 1180 |
| AD10564 | AM15044-AS | 592 | 1084 | AM13291-SS | 685 | 1151 |
| AD10565 | AM15045-AS | 593 | 1084 | AM13291-SS | 685 | 1151 |
| AD10566 | AM15046-AS | 594 | 1084 | AM13291-SS | 685 | 1151 |
| AD10567 | AM15047-AS | 595 | 1110 | AM14334-SS | 725 | 1177 |
| AD10568 | AM15048-AS | 596 | 1084 | AM13291-SS | 685 | 1151 |
| AD10569 | AM15048-AS | 596 | 1084 | AM15049-SS | 729 | 1151 |
| AD10570 | AM15050-AS | 597 | 1084 | AM15049-SS | 729 | 1151 |
| AD10571 | AM15052-AS | 598 | 1110 | AM15051-SS | 730 | 1177 |
| AD10572 | AM15050-AS | 597 | 1084 | AM13291-SS | 685 | 1151 |
| AD10573 | AM15054-AS | 599 | 1115 | AM15053-SS | 731 | 1182 |
| AD10574 | AM15055-AS | 600 | 1090 | AM13303-SS | 691 | 1157 |
| AD10575 | AM15056-AS | 601 | 1090 | AM13303-SS | 691 | 1157 |
| AD10576 | AM14371-AS | 589 | 1090 | AM15057-SS | 732 | 1157 |
| AD10577 | AM15058-AS | 602 | 1090 | AM13303-SS | 691 | 1157 |
| AD10578 | AM15059-AS | 603 | 1115 | AM15053-SS | 731 | 1182 |
| AD10579 | AM15060-AS | 604 | 1090 | AM13303-SS | 691 | 1157 |
| AD10580 | AM15061-AS | 605 | 1115 | AM15053-SS | 731 | 1182 |
| AD10581 | AM15062-AS | 606 | 1090 | AM13303-SS | 691 | 1157 |
| AD10694 | AM14365-AS | 583 | 1090 | AM14089-SS | 722 | 1157 |
| AD10695 | AM14369-AS | 587 | 1090 | AM14089-SS | 722 | 1157 |
| AD10696 | AM15245-AS | 607 | 1084 | AM13988-SS | 711 | 1151 |
| AD10697 | AM15246-AS | 609 | 1116 | AM13988-SS | 711 | 1151 |
| AD11066 | AM15751-AS | 610 | 1084 | AM15752-SS | 733 | 1151 |
| AD11068 | AM15048-AS | 596 | 1084 | AM15752-SS | 733 | 1151 |
| AD11196 | AM14342-AS | 578 | 1084 | AM15931-SS | 734 | 1151 |
| AD11197 | AM15932-AS | 611 | 1084 | AM15931-SS | 734 | 1151 |
| AD11198 | AM15933-AS | 612 | 1084 | AM15931-SS | 734 | 1151 |
| AD11199 | AM15934-AS | 613 | 1084 | AM15931-SS | 734 | 1151 |
| AD11200 | AM15935-AS | 614 | 1117 | AM15931-SS | 734 | 1151 |
| AD11201 | AM15936-AS | 615 | 1084 | AM15931-SS | 734 | 1151 |
| AD11274 | AM14342-AS | 578 | 1084 | AM16019-SS | 876 | 1151 |
| AD11275 | AM14342-AS | 578 | 1084 | AM16020-SS | 877 | 1151 |
| AD11276 | AM14342-AS | 578 | 1084 | AM14276-SS | 864 | 1151 |
| AD11277 | AM14342-AS | 578 | 1084 | AM16021-SS | 878 | 1151 |
| AD11278 | AM14342-AS | 578 | 1084 | AM16022-SS | 879 | 1151 |
| AD11279 | AM14342-AS | 578 | 1084 | AM16023-SS | 880 | 1151 |
| AD11280 | AM14342-AS | 578 | 1084 | AM16024-SS | 881 | 1151 |
| AD11295 | AM16051-AS | 616 | 1084 | AM13291-SS | 685 | 1151 |
| AD11335 | AM16114-AS | 618 | 1084 | AM13291-SS | 685 | 1151 |
| AD11340 | AM13292-AS | 526 | 1084 | AM15931-SS | 734 | 1151 |
| AD11341 | AM13924-AS | 548 | 1106 | AM16118-SS | 735 | 1173 |
| AD11342 | AM13304-AS | 532 | 1090 | AM16119-SS | 736 | 1157 |
| AD11343 | AM13306-AS | 533 | 1091 | AM16120-SS | 737 | 1158 |
| AD11344 | AM13314-AS | 537 | 1095 | AM16121-SS | 738 | 1162 |
| AD11358 | AM14371-AS | 589 | 1090 | AM16119-SS | 736 | 1157 |
| AD11359 | AM14371-AS | 589 | 1090 | AM16136-SS | 886 | 1157 |
| AD11360 | AM14371-AS | 589 | 1090 | AM16137-SS | 887 | 1157 |
| AD11361 | AM14371-AS | 589 | 1090 | AM16138-SS | 888 | 1157 |
| AD11362 | AM14371-AS | 589 | 1090 | AM16139-SS | 889 | 1157 |
| AD11363 | AM14371-AS | 589 | 1090 | AM14278-SS | 865 | 1157 |
| AD11364 | AM14371-AS | 589 | 1090 | AM16140-SS | 890 | 1157 |
| AD11365 | AM14371-AS | 589 | 1090 | AM16141-SS | 891 | 1157 |
| AD11370 | AM16144-AS | 620 | 1090 | AM16119-SS | 736 | 1157 |
| AD11371 | AM16145-AS | 621 | 1090 | AM16119-SS | 736 | 1157 |
| AD11372 | AM16146-AS | 622 | 1090 | AM16119-SS | 736 | 1157 |
| AD11373 | AM16147-AS | 623 | 1090 | AM16119-SS | 736 | 1157 |
| AD11384 | AM16169-AS | 624 | 1105 | AM16168-SS | 739 | 1172 |
| AD11385 | AM16171-AS | 625 | 1118 | AM16170-SS | 740 | 1183 |

TABLE 7A-continued

SOD1 RNAi Agent Duplexes with Corresponding Sense
and Antisense Strand ID Numbers and Sequence ID numbers for the modified
and unmodified nucleotide sequences. (Shown without Linking Agents or Conjugates)

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD11386 | AM16173-AS | 626 | 1119 | AM16172-SS | 741 | 1184 |
| AD11387 | AM16175-AS | 627 | 1120 | AM16174-SS | 745 | 1185 |
| AD11388 | AM16177-AS | 628 | 1121 | AM16176-SS | 743 | 1186 |
| AD11389 | AM16179-AS | 629 | 1122 | AM16178-SS | 744 | 1187 |
| AD11390 | AM16181-AS | 630 | 1123 | AM16180-SS | 745 | 1188 |
| AD11391 | AM16183-AS | 631 | 1124 | AM16182-SS | 746 | 1189 |
| AD11429 | AM16238-AS | 632 | 1125 | AM16237-SS | 747 | 1190 |
| AD11430 | AM16240-AS | 633 | 1126 | AM16239-SS | 748 | 1191 |
| AD11431 | AM16242-AS | 634 | 1127 | AM16241-SS | 749 | 1192 |
| AD11432 | AM16244-AS | 635 | 1114 | AM16243-SS | 750 | 1193 |
| AD11433 | AM16246-AS | 636 | 1128 | AM16245-SS | 751 | 1194 |
| AD11434 | AM16248-AS | 637 | 1129 | AM16247-SS | 752 | 1195 |
| AD11435 | AM16250-AS | 643 | 1130 | AM16249-SS | 753 | 1196 |
| AD11436 | AM16252-AS | 639 | 1131 | AM16251-SS | 754 | 1197 |
| AD11437 | AM16254-AS | 640 | 1132 | AM16253-SS | 755 | 1198 |
| AD11438 | AM16256-AS | 641 | 1133 | AM16255-SS | 756 | 1199 |
| AD11439 | AM16258-AS | 642 | 1134 | AM16257-SS | 757 | 1200 |
| AD11440 | AM16260-AS | 643 | 1135 | AM16259-SS | 758 | 1201 |
| AD11556 | AM15934-AS | 613 | 1084 | AM13291-SS | 685 | 1151 |
| AD11691 | AM14371-AS | 589 | 1090 | AM16616-SS | 759 | 1157 |
| AD11692 | AM15934-AS | 613 | 1084 | AM16617-SS | 760 | 1151 |
| AD11693 | AM13924-AS | 548 | 1106 | AM16118-SS | 735 | 1173 |
| AD11694 | AM13930-AS | 551 | 1109 | AM16619-SS | 762 | 1176 |
| AD11728 | AM15934-AS | 613 | 1084 | AM16672-SS | 763 | 1151 |
| AD11731 | AM15934-AS | 613 | 1084 | AM14276-SS | 864 | 1151 |
| AD11732 | AM15934-AS | 613 | 1084 | AM16022-SS | 879 | 1151 |
| AD11739 | AM15934-AS | 613 | 1084 | AM16688-SS | 764 | 1151 |
| AD11758 | AM15934-AS | 613 | 1084 | AM16705-SS | 765 | 1151 |
| AD11759 | AM15934-AS | 613 | 1084 | AM16706-SS | 766 | 1151 |
| AD11821 | AM15934-AS | 613 | 1084 | AM16800-SS | 767 | 1151 |
| AD11841 | AM15934-AS | 613 | 1084 | AM16814-SS | 768 | 1151 |
| AD11842 | AM15934-AS | 613 | 1084 | AM16815-SS | 769 | 1151 |
| AD11939 | AM16169-AS | 624 | 1105 | AM16168-SS | 739 | 1172 |
| AD11940 | AM16950-AS | 644 | 1105 | AM16168-SS | 739 | 1172 |
| AD11941 | AM16951-AS | 645 | 1105 | AM16168-SS | 739 | 1172 |
| AD11942 | AM16952-AS | 646 | 1105 | AM16168-SS | 739 | 1172 |
| AD11943 | AM16953-AS | 647 | 1105 | AM16168-SS | 739 | 1172 |
| AD11944 | AM16952-AS | 646 | 1105 | AM16954-SS | 771 | 1172 |
| AD11945 | AM16955-AS | 648 | 1105 | AM16168-SS | 739 | 1172 |
| AD11946 | AM16956-AS | 649 | 1105 | AM16168-SS | 739 | 1172 |
| AD11947 | AM16957-AS | 650 | 1105 | AM16954-SS | 771 | 1172 |
| AD11948 | AM16958-AS | 651 | 1105 | AM16168-SS | 739 | 1172 |
| AD12063 | AM15934-AS | 613 | 1084 | AM17098-SS | 925 | 1151 |
| AD12139 | AM14342-AS | 578 | 1084 | AM17192-SS | 772 | 1151 |

TABLE 7B

SOD1 RNAi Agent Duplexes with Corresponding Sense and Antisense Strand ID Numbers
and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD11066 | AM15751-AS | 610 | 1084 | AM15752-SS | 874 | 1151 |
| AD11068 | AM15048-AS | 596 | 1084 | AM15752-SS | 874 | 1151 |
| AD11196 | AM14342-AS | 578 | 1084 | AM15931-SS | 875 | 1151 |
| AD11197 | AM15932-AS | 611 | 1084 | AM15931-SS | 875 | 1151 |
| AD11198 | AM15933-AS | 612 | 1084 | AM15931-SS | 875 | 1151 |
| AD11199 | AM15934-AS | 613 | 1084 | AM15931-SS | 875 | 1151 |
| AD11200 | AM15935-AS | 614 | 1117 | AM15931-SS | 875 | 1151 |
| AD11201 | AM15936-AS | 615 | 1084 | AM15931-SS | 875 | 1151 |
| AD11340 | AM13292-AS | 526 | 1084 | AM15931-SS | 875 | 1151 |
| AD11341 | AM13924-AS | 548 | 1106 | AM16118-SS | 882 | 1173 |
| AD11342 | AM13304-AS | 532 | 1090 | AM16119-SS | 883 | 1157 |
| AD11343 | AM13306-AS | 533 | 1091 | AM16120-SS | 884 | 1158 |
| AD11344 | AM13314-AS | 537 | 1095 | AM16121-SS | 885 | 1162 |
| AD11358 | AM14371-AS | 589 | 1090 | AM16119-SS | 883 | 1157 |

TABLE 7B-continued

SOD1 RNAi Agent Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD11370 | AM16144-AS | 620 | 1090 | AM16119-SS | 883 | 1157 |
| AD11371 | AM16145-AS | 621 | 1090 | AM16119-SS | 883 | 1157 |
| AD11372 | AM16146-AS | 622 | 1090 | AM16119-SS | 883 | 1157 |
| AD11373 | AM16147-AS | 623 | 1090 | AM16119-SS | 883 | 1157 |
| AD11384 | AM16169-AS | 624 | 1105 | AM16168-SS | 892 | 1172 |
| AD11385 | AM16171-AS | 625 | 1118 | AM16170-SS | 893 | 1183 |
| AD11386 | AM16173-AS | 626 | 1119 | AM16172-SS | 894 | 1184 |
| AD11387 | AM16175-AS | 627 | 1120 | AM16174-SS | 895 | 1185 |
| AD11388 | AM16177-AS | 628 | 1121 | AM16176-SS | 896 | 1186 |
| AD11389 | AM16179-AS | 629 | 1122 | AM16178-SS | 897 | 1187 |
| AD11390 | AM16181-AS | 630 | 1123 | AM16180-SS | 898 | 1188 |
| AD11391 | AM16183-AS | 631 | 1124 | AM16182-SS | 899 | 1189 |
| AD11429 | AM16238-AS | 632 | 1125 | AM16237-SS | 900 | 1190 |
| AD11430 | AM16240-AS | 633 | 1126 | AM16239-SS | 901 | 1191 |
| AD11431 | AM16242-AS | 634 | 1127 | AM16241-SS | 902 | 1192 |
| AD11432 | AM16244-AS | 635 | 1114 | AM16243-SS | 903 | 1193 |
| AD11433 | AM16246-AS | 636 | 1128 | AM16245-SS | 904 | 1194 |
| AD11434 | AM16248-AS | 637 | 1129 | AM16247-SS | 905 | 1195 |
| AD11435 | AM16250-AS | 638 | 1130 | AM16249-SS | 906 | 1196 |
| AD11436 | AM16252-AS | 639 | 1131 | AM16251-SS | 907 | 1197 |
| AD11437 | AM16254-AS | 640 | 1132 | AM16253-SS | 908 | 1198 |
| AD11438 | AM16256-AS | 641 | 1133 | AM16255-SS | 909 | 1199 |
| AD11439 | AM16258-AS | 642 | 1134 | AM16257-SS | 910 | 1200 |
| AD11440 | AM16260-AS | 643 | 1135 | AM16259-SS | 911 | 1201 |
| AD11691 | AM14371-AS | 589 | 1090 | AM16616-SS | 912 | 1157 |
| AD11692 | AM15934-AS | 613 | 1084 | AM16617-SS | 913 | 1151 |
| AD11693 | AM13924-AS | 548 | 1106 | AM16118-SS | 882 | 1173 |
| AD11694 | AM13930-AS | 551 | 1109 | AM16619-SS | 915 | 1176 |
| AD11728 | AM15934-AS | 613 | 1084 | AM16672-SS | 916 | 1151 |
| AD11739 | AM15934-AS | 613 | 1084 | AM16688-SS | 917 | 1151 |
| AD11758 | AM15934-AS | 613 | 1084 | AM16705-SS | 918 | 1151 |
| AD11759 | AM15934-AS | 613 | 1084 | AM16706-SS | 919 | 1151 |
| AD11821 | AM15934-AS | 613 | 1084 | AM16800-SS | 920 | 1151 |
| AD11841 | AM15934-AS | 613 | 1084 | AM16814-SS | 921 | 1151 |
| AD11842 | AM15934-AS | 613 | 1084 | AM16815-SS | 922 | 1151 |
| AD11939 | AM16169-AS | 624 | 1105 | AM16168-SS | 892 | 1172 |
| AD11940 | AM16950-AS | 644 | 1105 | AM16168-SS | 892 | 1172 |
| AD11941 | AM16951-AS | 645 | 1105 | AM16168-SS | 892 | 1172 |
| AD11942 | AM16952-AS | 646 | 1105 | AM16168-SS | 892 | 1172 |
| AD11943 | AM16953-AS | 647 | 1105 | AM16168-SS | 892 | 1172 |
| AD11944 | AM16952-AS | 646 | 1105 | AM16954-SS | 924 | 1172 |
| AD11945 | AM16955-AS | 648 | 1105 | AM16168-SS | 892 | 1172 |
| AD11946 | AM16956-AS | 649 | 1105 | AM16168-SS | 892 | 1172 |
| AD11947 | AM16957-AS | 650 | 1105 | AM16954-SS | 924 | 1172 |
| AD11948 | AM16958-AS | 651 | 1105 | AM16168-SS | 892 | 1172 |
| AD12261 | AM16952-AS | 646 | 1105 | AM17382-SS | 977 | 1172 |

TABLE 8

SOD1 RNAi Agent Duplexes with Corresponding Sense and Antisense Strand ID Numbers and Sequence ID numbers for the modified and unmodified nucleotide sequences.
(Shown with PK/PD modulators)

| Duplex | SS ID | SS modified SEQ ID NO: | SS unmodified SEQ ID NO: | AS ID | AS modified SEQ ID NO: | AS unmodified SEQ ID NO: |
|---|---|---|---|---|---|---|
| AC001451 | CS001845 | 978 | 1147 | AM13284-AS | 522 | 1080 |
| AC001452 | CS001847 | 979 | 1148 | AM13286-AS | 523 | 1081 |
| AC001453 | CS001849 | 980 | 1149 | AM13288-AS | 524 | 1082 |
| AC001454 | CS001851 | 981 | 1150 | AM13290-AS | 525 | 1083 |
| AC001455 | CS001853 | 982 | 1151 | AM13292-AS | 526 | 1084 |
| AC001456 | CS001855 | 983 | 1152 | AM13294-AS | 527 | 1085 |
| AC001457 | CS001857 | 984 | 1153 | AM13296-AS | 528 | 1086 |
| AC001458 | CS001859 | 985 | 1154 | AM13298-AS | 529 | 1087 |
| AC001459 | CS001861 | 986 | 1155 | AM13300-AS | 530 | 1088 |
| AC001460 | CS001863 | 987 | 1156 | AM13302-AS | 531 | 1089 |
| AC001461 | CS001865 | 988 | 1157 | AM13304-AS | 532 | 1090 |

TABLE 8-continued

SOD1 RNAi Agent Duplexes with Corresponding Sense and Antisense Strand ID Numbers and Sequence ID numbers for the modified and unmodified nucleotide sequences.
(Shown with PK/PD modulators)

| Duplex | SS ID | SS modified SEQ ID NO: | SS unmodified SEQ ID NO: | AS ID | AS modified SEQ ID NO: | AS unmodified SEQ ID NO: |
|---|---|---|---|---|---|---|
| AC001462 | CS001867 | 989 | 1158 | AM13306-AS | 533 | 1091 |
| AC001463 | CS001869 | 990 | 1159 | AM13308-AS | 534 | 1092 |
| AC001464 | CS001871 | 991 | 1160 | AM13310-AS | 535 | 1093 |
| AC001465 | CS001873 | 992 | 1161 | AM13312-AS | 536 | 1094 |
| AC001466 | CS001875 | 993 | 1162 | AM13314-AS | 537 | 1095 |
| AC001467 | CS001877 | 994 | 1163 | AM13316-AS | 538 | 1096 |
| AC001468 | CS001879 | 995 | 1164 | AM13318-AS | 539 | 1097 |
| AC001469 | CS001881 | 996 | 1165 | AM13320-AS | 540 | 1098 |
| AC001470 | CS001883 | 997 | 1166 | AM13322-AS | 541 | 1099 |
| AC001471 | CS001885 | 998 | 1167 | AM13324-AS | 542 | 1100 |
| AC001472 | CS001887 | 999 | 1168 | AM13326-AS | 543 | 1101 |
| AC001473 | CS001889 | 1000 | 1169 | AM13328-AS | 544 | 1102 |
| AC001621 | CS002094 | 1001 | 1170 | AM13918-AS | 545 | 1103 |
| AC001622 | CS002096 | 1002 | 1171 | AM13920-AS | 546 | 1104 |
| AC001623 | CS002098 | 1003 | 1172 | AM13922-AS | 547 | 1105 |
| AC001624 | CS002100 | 1004 | 1173 | AM13924-AS | 548 | 1106 |
| AC001625 | CS002102 | 1005 | 1174 | AM13926-AS | 549 | 1107 |
| AC001626 | CS002104 | 1006 | 1175 | AM13928-AS | 550 | 1108 |
| AC001627 | CS002106 | 1007 | 1176 | AM13930-AS | 551 | 1109 |
| AC001801 | CS001865 | 1008 | 1157 | AM14365-AS | 583 | 1090 |
| AC001802 | CS001865 | 1008 | 1157 | AM14366-AS | 584 | 1090 |
| AC001803 | CS001865 | 1008 | 1157 | AM14367-AS | 585 | 1090 |
| AC001804 | CS001865 | 1008 | 1157 | AM14368-AS | 586 | 1090 |
| AC001805 | CS001865 | 1008 | 1157 | AM14369-AS | 587 | 1090 |
| AC001806 | CS001865 | 1008 | 1157 | AM14370-AS | 588 | 1090 |
| AC001807 | CS001865 | 1008 | 1157 | AM14371-AS | 589 | 1090 |
| AC001808 | CS002303 | 1009 | 1180 | AM14373-AS | 590 | 1113 |
| AC001809 | CS002305 | 1010 | 1177 | AM14020-AS | 554 | 1110 |
| AC001810 | CS001853 | 1011 | 1151 | AM14021-AS | 555 | 1084 |
| AC001811 | CS001853 | 1011 | 1151 | AM14022-AS | 556 | 1084 |
| AC001812 | CS001853 | 1011 | 1151 | AM14023-AS | 557 | 1084 |
| AC001813 | CS001853 | 1011 | 1151 | AM14024-AS | 558 | 1084 |
| AC001814 | CS001853 | 1011 | 1151 | AM14335-AS | 575 | 1084 |
| AC001815 | CS001853 | 1011 | 1151 | AM14339-AS | 576 | 1084 |
| AC001816 | CS002313 | 726 | 1181 | AM14339-AS | 576 | 1084 |
| AC001817 | CS001853 | 1011 | 1151 | AM14341-AS | 577 | 1084 |
| AC001818 | CS001853 | 1011 | 1151 | AM14342-AS | 578 | 1084 |
| AC001819 | CS001853 | 1011 | 1151 | AM14343-AS | 579 | 1084 |
| AC001820 | CS001853 | 1011 | 1151 | AM14344-AS | 580 | 1084 |
| AC001821 | CS001853 | 1011 | 1151 | AM14345-AS | 581 | 1084 |
| AC001822 | CS002319 | 1012 | 1178 | AM14347-AS | 582 | 1111 |
| AC002099 | CS002664 | 1013 | 1151 | AM14342-AS | 578 | 1084 |
| AC002101 | CS002666 | 1014 | 1151 | AM14342-AS | 578 | 1084 |
| AC002102 | CS002667 | 1015 | 1182 | AM15054-AS | 599 | 1115 |
| AC002103 | CS001865 | 1016 | 1157 | AM15055-AS | 600 | 1090 |
| AC002104 | CS001865 | 1016 | 1157 | AM15056-AS | 601 | 1090 |
| AC002105 | CS002671 | 1018 | 1157 | AM14371-AS | 589 | 1090 |
| AC002106 | CS001865 | 1016 | 1157 | AM15058-AS | 602 | 1090 |
| AC002107 | CS002667 | 1022 | 1182 | AM15059-AS | 603 | 1115 |
| AC002108 | CS001865 | 1016 | 1157 | AM15060-AS | 604 | 1090 |
| AC002109 | CS002667 | 1022 | 1182 | AM15061-AS | 605 | 1115 |
| AC002110 | CS001865 | 1016 | 1157 | AM15062-AS | 606 | 1090 |
| AC002111 | CS001853 | 982 | 1151 | AM15044-AS | 592 | 1084 |
| AC002112 | CS001853 | 982 | 1151 | AM15045-AS | 593 | 1084 |
| AC002113 | CS001853 | 982 | 1151 | AM15046-AS | 594 | 1084 |
| AC002114 | CS002305 | 1010 | 1177 | AM15047-AS | 595 | 1110 |
| AC002115 | CS001853 | 982 | 1151 | AM15048-AS | 594 | 1084 |
| AC002116 | CS002682 | 1025 | 1151 | AM15048-AS | 594 | 1084 |
| AC002117 | CS002682 | 1025 | 1151 | AM15050-AS | 597 | 1084 |
| AC002118 | CS002684 | 1027 | 1177 | AM15052-AS | 598 | 1110 |
| AC002119 | CS001853 | 982 | 1151 | AM15050-AS | 597 | 1084 |
| AC002272 | CS002884 | 1029 | 1151 | AM14342-AS | 578 | 1084 |
| AC002286 | CS002899 | 1030 | 1157 | AM14370-AS | 588 | 1090 |
| AC002287 | CS002900 | 1031 | 1157 | AM14370-AS | 588 | 1090 |
| AC002370 | CS001853 | 982 | 1151 | AM16051-AS | 616 | 1084 |
| AC002380 | CS001853 | 982 | 1151 | AM16114-AS | 618 | 1084 |
| AC002478 | CS001853 | 982 | 1151 | AM15934-AS | 613 | 1084 |
| AC002479 | CS002884 | 1029 | 1151 | AM15934-AS | 613 | 1084 |
| AC002547 | CS003254 | 685 | 1151 | AM15934-AS | 613 | 1084 |
| AC002548 | CS003255 | 1032 | 1151 | AM15934-AS | 613 | 1084 |
| AC002549 | CS003256 | 1033 | 1151 | AM15934-AS | 613 | 1084 |

TABLE 8-continued

SOD1 RNAi Agent Duplexes with Corresponding Sense and Antisense Strand ID Numbers and Sequence ID numbers for the modified and unmodified nucleotide sequences.
(Shown with PK/PD modulators)

| Duplex | SS ID | SS modified SEQ ID NO: | SS unmodified SEQ ID NO: | AS ID | AS modified SEQ ID NO: | AS unmodified SEQ ID NO: |
|---|---|---|---|---|---|---|
| AC002550 | CS003257 | 1034 | 1151 | AM15934-AS | 613 | 1084 |
| AC002551 | CS003258 | 1035 | 1151 | AM15934-AS | 613 | 1084 |
| AC910358 | CS913315 | 1036 | 1172 | AM16952-AS | 646 | 1105 |

TABLE 9A

Conjugate Duplex ID Numbers Referencing Position Targeted On SOD1 (SOD1) Gene

| Duplex | SS ID | AS ID | Duplex | Targeted SOD1 Gene Position (Of SEQ ID NO:1) |
|---|---|---|---|---|
| AC001451 | CS001845 | AM13284-AS | AD09381 | 150 |
| AC001452 | CS001847 | AM13286-AS | AD09382 | 202 |
| AC001453 | CS001849 | AM13288-AS | AD09383 | 212 |
| AC001454 | CS001851 | AM13290-AS | AD09384 | 257 |
| AC001455 | CS001853 | AM13292-AS | AD09385 | 264 |
| AC001456 | CS001855 | AM13294-AS | AD09386 | 304 |
| AC001457 | CS001857 | AM13296-AS | AD09387 | 373 |
| AC001458 | CS001859 | AM13298-AS | AD09388 | 510 |
| AC001459 | CS001861 | AM13300-AS | AD09389 | 540 |
| AC001460 | CS001863 | AM13302-AS | AD09390 | 544 |
| AC001461 | CS001865 | AM13304-AS | AD09391 | 571 |
| AC001462 | CS001867 | AM13306-AS | AD09392 | 583 |
| AC001463 | CS001869 | AM13308-AS | AD09393 | 591 |
| AC001464 | CS001871 | AM13310-AS | AD09394 | 593 |
| AC001465 | CS001873 | AM13312-AS | AD09395 | 601 |
| AC001466 | CS001875 | AM13314-AS | AD09396 | 609 |
| AC001467 | CS001877 | AM13316-AS | AD09397 | 616 |
| AC001468 | CS001879 | AM13318-AS | AD09398 | 668 |
| AC001469 | CS001881 | AM13320-AS | AD09399 | 691 |
| AC001470 | CS001883 | AM13322-AS | AD09400 | 708 |
| AC001471 | CS001885 | AM13324-AS | AD09401 | 750 |
| AC001472 | CS001887 | AM13326-AS | AD09402 | 779 |
| AC001473 | CS001889 | AM13328-AS | AD09403 | 788 |
| AC001621 | CS002094 | AM13918-AS | AD09754 | 140 |
| AC001622 | CS002096 | AM13920-AS | AD09755 | 203 |
| AC001623 | CS002098 | AM13922-AS | AD09756 | 375 |
| AC001624 | CS002100 | AM13924-AS | AD09757 | 438 |
| AC001625 | CS002102 | AM13926-AS | AD09758 | 586 |
| AC001626 | CS002104 | AM13928-AS | AD09759 | 702 |
| AC001627 | CS002106 | AM13930-AS | AD09760 | 784 |
| AC001801 | CS001865 | AM14365-AS | AD10077 | 571 |
| AC001802 | CS001865 | AM14366-AS | AD10078 | 571 |
| AC001803 | CS001865 | AM14367-AS | AD10079 | 571 |
| AC001804 | CS001865 | AM14368-AS | AD10080 | 571 |
| AC001805 | CS001865 | AM14369-AS | AD10081 | 571 |
| AC001806 | CS001865 | AM14370-AS | AD10082 | 571 |
| AC001807 | CS001865 | AM14371-AS | AD10083 | 571 |
| AC001808 | CS002303 | AM14373-AS | AD10084 | 571 |
| AC001809 | CS002305 | AM14020-AS | AD10055 | 264 |
| AC001810 | CS001853 | AM14021-AS | AD10056 | 264 |
| AC001811 | CS001853 | AM14022-AS | AD10057 | 264 |
| AC001812 | CS001853 | AM14023-AS | AD10058 | 264 |
| AC001813 | CS001853 | AM14024-AS | AD10059 | 264 |
| AC001814 | CS001853 | AM14335-AS | AD10061 | 264 |
| AC001815 | CS001853 | AM14339-AS | AD10066 | 264 |
| AC001816 | CS002313 | AM14339-AS | AD10067 | 264 |
| AC001817 | CS001853 | AM14341-AS | AD10068 | 264 |
| AC001818 | CS001853 | AM14342-AS | AD10069 | 264 |
| AC001819 | CS001853 | AM14343-AS | AD10070 | 264 |
| AC001820 | CS001853 | AM14344-AS | AD10071 | 264 |
| AC001821 | CS001853 | AM14345-AS | AD10072 | 264 |
| AC001822 | CS002319 | AM14347-AS | AD10073 | 264 |
| AC002099 | CS002664 | AM14342-AS | AD10069 | 264 |
| AC002101 | CS002666 | AM14342-AS | AD10069 | 264 |
| AC002102 | CS002667 | AM15054-AS | AD10573 | 571 |
| AC002103 | CS001865 | AM15055-AS | AD10574 | 571 |
| AC002104 | CS001865 | AM15056-AS | AD10575 | 571 |
| AC002105 | CS002671 | AM14371-AS | AD10576 | 571 |
| AC002106 | CS001865 | AM15058-AS | AD10577 | 571 |
| AC002107 | CS002667 | AM15059-AS | AD10578 | 571 |
| AC002108 | CS001865 | AM15060-AS | AD10579 | 571 |
| AC002109 | CS002667 | AM15061-AS | AD10580 | 571 |
| AC002110 | CS001865 | AM15062-AS | AD10581 | 571 |
| AC002111 | CS001853 | AM15044-AS | AD10564 | 264 |
| AC002112 | CS001853 | AM15045-AS | AD10565 | 264 |
| AC002113 | CS001853 | AM15046-AS | AD10566 | 264 |
| AC002114 | CS002305 | AM15047-AS | AD10567 | 264 |
| AC002115 | CS001853 | AM15048-AS | AD10568 | 264 |
| AC002116 | CS002682 | AM15048-AS | AD10569 | 264 |
| AC002117 | CS002682 | AM15050-AS | AD10570 | 264 |
| AC002118 | CS002684 | AM15052-AS | AD10571 | 264 |
| AC002119 | CS001853 | AM15050-AS | AD10572 | 264 |
| AC002272 | CS002884 | AM14342-AS | AD10069 | 264 |
| AC002286 | CS002899 | AM14370-AS | AD10082 | 571 |
| AC002287 | CS002900 | AM14370-AS | AD10082 | 571 |
| AC002370 | CS001853 | AM16051-AS | AD11295 | 264 |
| AC002380 | CS001853 | AM16114-AS | AD11335 | 264 |
| AC002478 | CS001853 | AM15934-AS | AD11556 | 264 |
| AC002479 | CS002884 | AM15934-AS | AD11556 | 264 |
| AC002547 | CS003254 | AM15934-AS | AD11556 | 264 |
| AC002548 | CS003255 | AM15934-AS | AD11556 | 264 |
| AC002549 | CS003256 | AM15934-AS | AD11556 | 264 |
| AC002550 | CS003257 | AM15934-AS | AD11556 | 264 |
| AC002551 | CS003258 | AM15934-AS | AD11556 | 264 |
| AC910358 | CS913315 | AM16952-AS | AD12261 | 375 |

TABLE 10

| Conjugate ID Numbers With Chemically Modified Antisense and Sense Strands (including Linkers and Conjugates) | | |
|---|---|---|
| ACID Number | Sense Strand (Fully Modified with Conjugated PK/PD modulator) (5' → 3') | SEQ ID NO: |
| AC001451 | LP183-(NH-C6)s(invAb)sgaaaguaaUfGfGfaccagugaaas(invAb) | 978 |
| AC001452 | LP183-(NH-C6)s(invAb)sgccugcauGfGfAfuuccauguuas(invAb) | 979 |
| AC001453 | LP183-(NH-C6)s(invAb)sauuccaugUfUfCfaugaguugas(invAb) | 980 |
| AC001454 | LP183-(NH-C6)s(invAb)sugcaggucCfUfCfacuuuaaucas(invAb) | 981 |
| AC001455 | LP183-(NH-C6)s(invAb)sccucacuuUfAfAfucccucuaucas(invAb) | 982 |
| AC001456 | LP183-(NH-C6)s(invAb)saggaugaaGfAfGfaggcauguuas(invAb) | 983 |
| AC001457 | LP183-(NH-C6)s(invAb)scuauugaaGfAfUfucugugaucus(invAb) | 984 |
| AC001458 | LP183-(NH-C6)s(invAb)suuggcuugUfGfGfuguaauuggas(invAb) | 985 |
| AC001459 | LP183-(NH-C6)s(invAb)sua_2NaacauuCfCfCfuuggauguaas(invAb) | 986 |
| AC001460 | LP183-(NH-C6)s(invAb)scauucccuUfGfGfauguagucuas(invAb) | 987 |
| AC001461 | LP183-(NH-C6)s(invAb)scuuaacucAfUfCfuguuauccuas(invAb) | 988 |
| AC001462 | LP183-(NH-C6)s(invAb)sguuauccuGfCfUfagcuguagaas(invAb) | 989 |
| AC001463 | LP183-(NH-C6)s(invAb)sgcuagcugUfAfGfaaauguaucas(invAb) | 990 |
| AC001464 | LP183-(NH-C6)s(invAb)suagcuguaGfAfAfauguauccuas(invAb) | 991 |
| AC001465 | LP183-(NH-C6)s(invAb)sgaaauguaUfCfCfugauaaacaus(invAb) | 992 |
| AC001466 | LP183-(NH-C6)s(invAb)succugauaAfAfCfauuaaacacus(invAb) | 993 |
| AC001467 | LP183-(NH-C6)s(invAb)sa_2NaacauuaAfAfCfacuguaaucus(invAb) | 994 |
| AC001468 | LP183-(NH-C6)s(invAb)sugcuuuaaAfGfUfaccuguaguas(invAb) | 995 |
| AC001469 | LP183-(NH-C6)s(invAb)saaacugauUfUfAfugaucacuuas(invAb) | 996 |
| AC001470 | LP183-(NH-C6)s(invAb)scuuggaagAfUfUfuguauaguuus(invAb) | 997 |
| AC001471 | LP183-(NH-C6)s(invAb)scuguuucaAfUfGfaccuguauuus(invAb) | 998 |
| AC001472 | LP183-(NH-C6)s(invAb)suuaaaucaCfAfGfaugggauuuas(invAb) | 999 |
| AC001473 | LP183-(NH-C6)s(invAb)sa_2NgaugggAfUfUfaaacuugucas(invAb) | 1000 |
| AC001621 | LP183-(NH-C6)s(invAb)scgagcagaAfGfGfaaaguaaugas(invAb) | 1001 |
| AC001622 | LP183-(NH-C6)s(invAb)sccugcaugGfAfUfuccauguucas(invAb) | 1002 |
| AC001623 | LP183-(NH-C6)s(invAb)sguugaagaUfUfCfugugaucucas(invAb) | 1003 |
| AC001624 | LP183-(NH-C6)s(invAb)sca_2NugaaaaAfGfCfagaugacuuus(invAb) | 1004 |
| AC001625 | LP183-(NH-C6)s(invAb)sauccugcuAfGfCfuguagaaauus(invAb) | 1005 |
| AC001626 | LP183-(NH-C6)s(invAb)suga_2NucacuUfGfGfaagauuuguus(invAb) | 1006 |
| AC001627 | LP183-(NH-C6)s(invAb)sucacagauGfGfGfuauuaaacuus(invAb) | 1007 |
| AC001801 | LP183-(NH-C6)s(invAb)scuuaacucAfUfCfuguuauccuas(invAb) | 1008 |
| AC001802 | LP183-(NH-C6)s(invAb)scuuaacucAfUfCfuguuauccuas(invAb) | 1008 |
| AC001803 | LP183-(NH-C6)s(invAb)scuuaacucAfUfCfuguuauccuas(invAb) | 1008 |
| AC001804 | LP183-(NH-C6)s(invAb)scuuaacucAfUfCfuguuauccuas(invAb) | 1008 |
| AC001805 | LP183-(NH-C6)s(invAb)scuuaacucAfUfCfuguuauccuas(invAb) | 1008 |
| AC001806 | LP183-(NH-C6)s(invAb)scuuaacucAfUfCfuguuauccuas(invAb) | 1008 |
| AC001807 | LP183-(NH-C6)s(invAb)scuuaacucAfUfCfuguuauccuas(invAb) | 1008 |

TABLE 10-continued

| Conjugate ID Numbers With Chemically Modified Antisense and Sense Strands (including Linkers and Conjugates) | | |
|---|---|---|
| AC001808 | LP183-(NH-C6)s(invAb)sua_2NacucAfUfCfuguuauccuas(invAb) | 1009 |
| AC001809 | LP183-(NH-C6)s(invAb)sgcucacuuUfAfAfuccucuaucas(invAb) | 1010 |
| AC001810 | LP183-(NH-C6)s(invAb)sccucacuuUfAfAfuccucuaucas(invAb) | 1011 |
| AC001811 | LP183-(NH-C6)s(invAb)sccucacuuUfAfAfuccucuaucas(invAb) | 1011 |
| AC001812 | LP183-(NH-C6)s(invAb)sccucacuuUfAfAfuccucuaucas(invAb) | 1011 |
| AC001813 | LP183-(NH-C6)s(invAb)sccucacuuUfAfAfuccucuaucas(invAb) | 1011 |
| AC001814 | LP183-(NH-C6)s(invAb)sccucacuuUfAfAfuccucuaucas(invAb) | 1011 |
| AC001815 | LP183-(NH-C6)s(invAb)sccucacuuUfAfAfuccucuaucas(invAb) | 1011 |
| AC001816 | LP183-(NH-C6)s(invAb)sccucacuuUfAfAfuccucuauuas(invAb) | 726 |
| AC001817 | LP183-(NH-C6)s(invAb)sccucacuuUfAfAfuccucuaucas(invAb) | 1011 |
| AC001818 | LP183-(NH-C6)s(invAb)sccucacuuUfAfAfuccucuaucas(invAb) | 1011 |
| AC001819 | LP183-(NH-C6)s(invAb)sccucacuuUfAfAfuccucuaucas(invAb) | 1011 |
| AC001820 | LP183-(NH-C6)s(invAb)sccucacuuUfAfAfuccucuaucas(invAb) | 1011 |
| AC001821 | LP183-(NH-C6)s(invAb)sccucacuuUfAfAfuccucuaucas(invAb) | 1011 |
| AC001822 | LP183-(NH-C6)s(invAb)sucacuuUfAfAfuccucuaucas(invAb) | 1012 |
| AC002099 | LP304-(NH-C6)s(invAb)sccucacuuUfAfAfuccucuaucas(invAb) | 1013 |
| AC002101 | LP310-(NH-C6)s(invAb)sccucacuuUfAfAfuccucuaucas(invAb) | 1014 |
| AC002102 | LP183-(NH-C6)s(invAb)sguuaacucAfUfCfuguuauccuas(invAb) | 1015 |
| AC002103 | LP183-(NH-C6)s(invAb)scuuaacucAfUfCfuguuauccuas(invAb) | 1016 |
| AC002104 | LP183-(NH-C6)s(invAb)scuuaacucAfUfCfuguuauccuas(invAb) | 1016 |
| AC002105 | LP183-(NH-C6)s(invAb)scuuaAfcucAfUfCfUfguuauccuas(invAb) | 1018 |
| AC002106 | LP183-(NH-C6)s(invAb)scuuaacucAfUfCfuguuauccuas(invAb) | 1016 |
| AC002107 | LP183-(NH-C6)s(invAb)sguuaacucAfUfCfuguuauccuas(invAb) | 1022 |
| AC002108 | LP183-(NH-C6)s(invAb)scuuaacucAfUfCfuguuauccuas(invAb) | 1016 |
| AC002109 | LP183-(NH-C6)s(invAb)sguuaacucAfUfCfuguuauccuas(invAb) | 1022 |
| AC002110 | LP183-(NH-C6)s(invAb)scuuaacucAfUfCfuguuauccuas(invAb) | 1016 |
| AC002111 | LP183-(NH-C6)s(invAb)sccucacuuUfAfAfuccucuaucas(invAb) | 982 |
| AC002112 | LP183-(NH-C6)s(invAb)sccucacuuUfAfAfuccucuaucas(invAb) | 982 |
| AC002113 | LP183-(NH-C6)s(invAb)sccucacuuUfAfAfuccucuaucas(invAb) | 982 |
| AC002114 | LP183-(NH-C6)s(invAb)sgcucacuuUfAfAfuccucuaucas(invAb) | 1010 |
| AC002115 | LP183-(NH-C6)s(invAb)sccucacuuUfAfAfuccucuaucas(invAb) | 982 |
| AC002116 | LP183-(NH-C6)s(invAb)sccucAfcuuUfAfAfUfccucuaucas(invAb) | 1025 |
| AC002117 | LP183-(NH-C6)s(invAb)sccucAfcuuUfAfAfUfccucuaucas(invAb) | 1025 |
| AC002118 | LP183-(NH-C6)s(invAb)sgcucAfcuuUfAfAfUfccucuaucas(invAb) | 1027 |
| AC002119 | LP183-(NH-C6)s(invAb)sccucacuuUfAfAfuccucuaucas(invAb) | 982 |
| AC002272 | LP293-(NH-C6)s(invAb)sccucacuuUfAfAfuccucuaucas(invAb) | 1029 |
| AC002286 | LP310-(NH-C6)s(invAb)scuuaacucAfUfCfuguuauccuas(invAb) | 1030 |
| AC002287 | LP293-(NH-C6)s(invAb)scuuaacucAfUfCfuguuauccuas(invAb) | 1031 |

TABLE 10-continued

Conjugate ID Numbers With Chemically Modified Antisense and Sense Strands (including Linkers and Conjugates)

| | | |
|---|---|---|
| AC002370 | LP183-(NH-C6)s(invAb)sccucacuuUfAfAfuccucuaucas(invAb) | 982 |
| AC002380 | LP183-(NH-C6)s(invAb)sccucacuuUfAfAfuccucuaucas(invAb) | 982 |
| AC002381 | LP183-(NH-C6)s(invAb)sccucacuuUfAfAfuccucuaucas(invAb) | 982 |
| AC002478 | LP183-(NH-C6)s(invAb)sccucacuuUfAfAfuccucuaucas(invAb) | 1029 |
| AC002479 | LP293-(NH-C6)s(invAb)sccucacuuUfAfAfuccucuaucas(invAb) | 685 |
| AC002548 | LP283-(NH-C6)s(invAb)sccucacuuUfAfAfuccucuaucas(invAb) | 1032 |
| AC002549 | LP383-(NH-C6)s(invAb)sccucacuuUfAfAfuccucuaucas(invAb) | 1033 |
| AC002550 | LP396-(NH-C6)s(invAb)sccucacuuUfAfAfuccucuaucas(invAb) | 1034 |
| AC002551 | LP395-(NH-C6)s(invAb)sccucacuuUfAfAfuccucuaucas(invAb) | 1035 |
| AC910358 | LP293-(NH-C6)s(invAb)sguugaagaUfuCfuGfugaucucas(invAb) | 1036 |

| ACID Number | Antisense Strand (5' → 3') | SEQ ID NO: |
|---|---|---|
| AC001451 | usUfsusCfaCfuggucCfaUfuAfcUfuusc | 522 |
| AC001452 | usAfsasCfaUfggaauCfcAfuGfcAfggsc | 523 |
| AC001453 | usCfsasAfaCfucaugAfaCfaUfgGfaasu | 524 |
| AC001454 | usGfsasUfuAfaagugAfgGfaCfcCfUfgcsa | 525 |
| AC001455 | usGfsasUfaGfaggauUfaAfaGfuGfagsg | 526 |
| AC001456 | usAfsasCfaUfgccucUfcUfuCfaUfccsu | 527 |
| AC001457 | asGfsasUfc AfcagaaUfcUfuCfaAfuasg | 528 |
| AC001458 | usCfscsAfaUfuacacCfaCfaAfgCfcasa | 529 |
| AC001459 | usUfsasCfaUfccaagGfgAfaUfgUfuusa | 530 |
| AC001460 | usAfsgsAfcUfacaucCfaAfgGfgAfausg | 531 |
| AC001461 | usAfsgsGfaUfaacagAfuGfaGfuUfaasg | 532 |
| AC001462 | usUfscsUfaCfagcuaGfcAfgGfaUfaasc | 533 |
| AC001463 | usGfsasUfaCfauuucUfaCfaGfcUfagsc | 534 |
| AC001464 | usAfsgsGfaUfacauuUfcCfaCfaGfcusa | 535 |
| AC001465 | asUfsgsUfuUfaucagGfaUfaCfaUfuusc | 536 |
| AC001466 | asGfsusGfuUfuaaugUfuUfaUfcAfggsa | 537 |
| AC001467 | asGfsasUfuAfcagugUfuUfaAfuGfuusu | 538 |
| AC001468 | usAfscsUfaCfagguaCfuUfuAfaAfgcsa | 539 |
| AC001469 | usAfsasGfuGfaucau AfaAfuCfaGfuusu | 540 |
| AC001470 | asAfsasCfuAfuacaaAfuCfuUfcCfaasg | 541 |
| AC001471 | asAfsasUfaCfaggucAfuUfgAfaAfcasg | 542 |
| AC001472 | usAfsasUfaCfccaucUfgUfgAfuUfuasa | 543 |
| AC001473 | usGfsasCfaAfguuuaAfuAfcCfcAfucsu | 544 |
| AC001621 | usCfsasUfuAfcuuucCfuUfcUfgCfucsg | 545 |
| AC001622 | usGfsasAfcAfuggaaUfcCfaUfgCfagsg | 546 |
| AC001623 | usGfsasGfaUfcacagAfaUfcUfuCfaasc | 547 |
| AC001624 | as AfsasGfuCfaucugCfuUfuUfuCfausg | 548 |

TABLE 10-continued

Conjugate ID Numbers With Chemically Modified Antisense and Sense Strands (including Linkers and Conjugates)

| | | |
|---|---|---|
| AC001625 | asAfsusUfuCfuacagCfuAfgCfaGfgasu | 549 |
| AC001626 | asAfscsAfaAfucuuCCfaAfgUfgAfucsa | 550 |
| AC001627 | asAfsgsUfuUfaauacCfcAfuCfuGfugsa | 551 |
| AC001801 | usAfsgsGfauaacagAfuGfaGfuuaasg | 583 |
| AC001802 | usAfsgsgAfuaacagAfuGfaGfuuaasg | 584 |
| AC001803 | usAfsgsgauAfacagAfuGfaGfuuaasg | 585 |
| AC001804 | usAfsgsGfauaacagAfuGfaGfuua_2Nasg | 586 |
| AC001805 | usAfsgsGfauaacagAfuGfaGfuuaassg | 587 |
| AC001806 | cPrpusAfsgsGfauaacagAfuGfaGfuuaassg | 588 |
| AC001807 | cPrpuAfgGfauaacagAfuGfaGfuuaassg | 589 |
| AC001808 | cPrpusAfsgsGfauaacagAfuGfaGfuussa | 590 |
| AC001809 | usGfsasuaGfaggauUfaAfaGfugagssc | 554 |
| AC001810 | usGfsasuaGfaggAfuUfaAfaGfugagsg | 555 |
| AC001811 | usGfsasuagaggAfuUfaAfaGfugagsg | 556 |
| AC001812 | usGfsasuagaggauUfaAfaGfugagsg | 557 |
| AC001813 | cPrpuGfauaGfaggauUfaAfaGfugagssg | 558 |
| AC001814 | cPrpusGfsasuagaggAfuUfaAfaGfugagssg | 575 |
| AC001815 | usGfsasuagaggAfuUfaAfaGfugagssg | 576 |
| AC001816 | usGfsasuagaggAfuUfaAfaGfugagsg | 576 |
| AC001817 | cPrpusGfsasuagaggAfuUfaAfaGfugagsg | 577 |
| AC001818 | cPrpusGfsasuagAfggAfuUfaAfaGfugagsg | 578 |
| AC001819 | cPrpusGfsasuAfgaggAfuUfaAfaGfugagsg | 579 |
| AC001820 | cPrpusGfsasUfagaggAfuUfaAfaGfugagsg | 580 |
| AC001821 | cPrpuGfauagaggAfuUfaAfaGfugagssg | 581 |
| AC001822 | cPrpusGfsasuagaggAfuUfaAfaGfugssa | 582 |
| AC002099 | cPrpusGfsasuagAfggAfuUfaAfaGfugagsg | 578 |
| AC002101 | cPrpusGfsasuagAfggAfuUfaAfaGfugagsg | 578 |
| AC002102 | cPrpuAfgGfauaacagAfuGfaGfuuaassc | 599 |
| AC002103 | cPrpuAfgGfauaacagAfuGfaGfuuaasg | 600 |
| AC002104 | cPrpuAfgGfauaacagAfuGfaGfuuasasg | 601 |
| AC002105 | cPrpuAfgGfauaacagAfuGfaGfuuaassg | 589 |
| AC002106 | cPrpuAfggAfuaac AfgAfuGfaGfuuaassg | 602 |
| AC002107 | cPrpuAfggAfuaac AfgAfuGfaGfuuaassc | 603 |
| AC002108 | cPrpuAfggauaacAfgAfuGfaGfuuaassg | 604 |
| AC002109 | cPrpuAfggauaacAfgAfuGfaGfuuaassc | 605 |
| AC002110 | cPrpuAfggAfuaAfcagauGfaGfuuaassg | 606 |
| AC002111 | cPrpusGfsasuagAfggAfuUfaAfaGfugagssg | 592 |
| AC002112 | cPrpuGfauagAfggAfuUfaAfaGfugagssg | 593 |

TABLE 10-continued

Conjugate ID Numbers With Chemically Modified Antisense and Sense Strands (including Linkers and Conjugates)

| | | |
|---|---|---|
| AC002113 | cPrpuGfauagAfggAfuUfaAfaGfugasgsg | 594 |
| AC002114 | cPrpuGfauagAfggAfuUfaAfaGfugagssc | 595 |
| AC002115 | cPrpuGfauagaGfgAfuUfaAfaGfugagssg | 594 |
| AC002116 | cPrpuGfauagaGfgAfuUfaAfaGfugagssg | 594 |
| AC002117 | cPrpuGfauagAfgGfauuaAfaGfugagssg | 597 |
| AC002118 | cPrpuGfauagAfgGfauuaAfaGfugagssc | 598 |
| AC002119 | cPrpuGfauagAfgGfauuaAfaGfugagssg | 597 |
| AC002272 | cPrpusGfsasuagAfggAfuUfaAfaGfugagsg | 578 |
| AC002286 | cPrpusAfsgsGfauaacagAfuGfaGfuuaassg | 588 |
| AC002287 | cPrpusAfsgsGfauaacagAfuGfaGfuuaassg | 588 |
| AC002370 | cPrpusgsasuagagGfAfUfuaaagugagsgs(invAb) | 616 |
| AC002380 | cPrpusgsasuAfgAfggAfuUfaaaGfuGfagsg | 618 |
| AC002381 | (invAb)susgsauAfgAfggAfuUfaaaGfuGfagsg | 613 |
| AC002478 | cPrpusGfsasuagA$_{UNA}$ggAfuUfaAfaGfugagsg | 613 |
| AC002479 | cPrpusGfsasuagA$_{UNA}$ggAfuUfaAfaGfugagsg | 613 |
| AC002548 | cPrpusGfsasuagA$_{UNA}$ggAfuUfaAfaGfugagsg | 613 |
| AC002549 | cPrpusGfsasuagA$_{UNA}$ggAfuUfaAfaGfugagsg | 613 |
| AC002550 | cPrpusGfsasuagA$_{UNA}$ggAfuUfaAfaGfugagsg | 613 |
| AC002551 | cPrpusGfsasuagA$_{UNA}$ggAfuUfaAfaGfugagsg | 613 |
| AC910358 | cPrpusGfsaGfaucacagAfaUfcUfucasasc | 646 |

In some embodiments, a SOD1 RNAi agent is prepared or provided as a salt, mixed salt, or a free-acid. In some embodiments, a SOD1 RNAi agent is prepared or provided as a pharmaceutically acceptable salt. In some embodiments, a SOD1 RNAi agent is prepared or provided as a pharmaceutically acceptable sodium or potassium salt The RNAi agents described herein, upon delivery to a cell expressing an SOD1 gene, inhibit or knockdown expression of one or more SOD1 genes in vivo and/or in vitro.

Targeting Groups, Linking Groups, Lipid PK/PD Moieties, and Delivery Vehicles

In some embodiments, a SOD1 RNAi agent contains or is conjugated to one or more non-nucleotide groups including, but not limited to, a targeting group, a linking group, a pharmacokinetic/pharmacodynamic (PK/PD) modulator, a delivery polymer, or a delivery vehicle. The non-nucleotide group can enhance targeting, delivery, or attachment of the RNAi agent. The non-nucleotide group can be covalently linked to the 3' and/or 5' end of either the sense strand and/or the antisense strand. In some embodiments, a SOD1 RNAi agent contains a non-nucleotide group linked to the 3' and/or 5' end of the sense strand. In some embodiments, a non-nucleotide group is linked to the 5' end of a SOD1 RNAi agent sense strand. A non-nucleotide group can be linked directly or indirectly to the RNAi agent via a linker/linking group. In some embodiments, a non-nucleotide group is linked to the RNAi agent via a labile, cleavable, or reversible bond or linker.

In some embodiments, a non-nucleotide group enhances the pharmacokinetic or biodistribution properties of an RNAi agent or conjugate to which it is attached to improve cell- or tissue-specific distribution and cell-specific uptake of the conjugate. In some embodiments, a non-nucleotide group enhances endocytosis of the RNAi agent.

Targeting groups or targeting moieties enhance the pharmacokinetic or biodistribution properties of a conjugate or RNAi agent to which they are attached to improve cell-specific (including, in some cases, organ specific) distribution and cell-specific (or organ specific) uptake of the conjugate or RNAi agent. A targeting group can be monovalent, divalent, trivalent, tetravalent, or have higher valency for the target to which it is directed. Representative targeting groups include, without limitation, compounds with affinity to cell surface molecule, cell receptor ligands, hapten, antibodies, monoclonal antibodies, antibody fragments, and antibody mimics with affinity to cell surface molecules. In some embodiments, a targeting group is linked to an RNAi agent using a linker, such as a PEG linker or one, two, or three abasic and/or ribitol (abasic ribose) residues, which in some instances can serve as linkers.

A targeting group, with or without a linker, can be attached to the 5' or 3' end of any of the sense and/or antisense strands disclosed in Tables 2, 3, 4, 5, 6, and 10. A linker, with or without a targeting group, can be attached to the 5' or 3' end of any of the sense and/or antisense strands disclosed in Tables 2, 3, 4, 5, 6, and 10.

The SOD1 RNAi agents described herein can be synthesized having a reactive group, such as an amino group (also referred to herein as an amine), at the 5'-terminus and/or the 3'-terminus. The reactive group can be used subsequently to attach a targeting moiety using methods typical in the art.

For example, in some embodiments, the SOD1 RNAi agents disclosed herein are synthesized having an $NH_2$-$C_6$ group at the 5'-terminus of the sense strand of the RNAi agent. The terminal amino group subsequently can be reacted to form a conjugate with, for example, a group that includes a lipid moiety. In some embodiments, the SOD1 RNAi agents disclosed herein are synthesized having one or more alkyne groups at the 5'-terminus of the sense strand of the RNAi agent.

In some embodiments, targeting groups are linked to the SOD1 RNAi agents without the use of an additional linker. In some embodiments, the targeting group is designed having a linker readily present to facilitate the linkage to a SOD1 RNAi agent. In some embodiments, when two or more RNAi agents are included in a composition, the two or more RNAi agents can be linked to their respective targeting groups using the same linkers. In some embodiments, when two or more RNAi agents are included in a composition, the two or more RNAi agents are linked to their respective targeting groups using different linkers.

In some embodiments, a linking group is conjugated to the RNAi agent. The linking group facilitates covalent linkage of the agent to a targeting group, pharmacokinetic modulator, delivery polymer, or delivery vehicle. The linking group can be linked to the 3' and/or the 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments, a linking group is conjugated to the 5' end of an RNAi agent sense strand. Examples of linking groups, include but are not limited to: C6-SS—C6, 6—SS-6, reactive groups such a primary amines (e.g., NH2-C6) and alkynes, alkyl groups, abasic residues/nucleotides, amino acids, tri-alkyne functionalized groups, ribitol, and/or PEG groups. Examples of certain linking groups are provided in Table 11.

A linker or linking group is a connection between two atoms that links one chemical group (such as an RNAi agent) or segment of interest to another chemical group (such as a targeting group, pharmacokinetic modulator, or delivery polymer) or segment of interest via one or more covalent bonds. A labile linkage contains a labile bond. A linkage can optionally include a spacer that increases the distance between the two joined atoms. A spacer may further add flexibility and/or length to the linkage. Spacers include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description. In some embodiments, a SOD1 RNAi agent is conjugated to a polyethylene glycol (PEG) moiety, or to a hydrophobic group having 12 or more carbon atoms, such as a cholesterol or palmitoyl group.

In some embodiments, a SOD1 RNAi agent is linked to one or more lipid PK/PD moieties (referred to herein as "lipid moieties" or "PK/PD modulators".) Lipid PK/PD moieties may enhance the pharmacodynamic or pharmacokinetic properties of the RNAi agent. In some embodiments, the lipid moiety may be conjugated to a linker at the 3' or 5' end of a sense strand or an antisense strand of an RNAi agent described herein. In some embodiments, a lipid moiety may be linked at both the 3' or 5' end of either the sense strand or the antisense strand of an RNAi agent described herein.

In some embodiments, a lipid moiety may be conjugated to a SOD1 RNAi agent by reacting a SOD1 RNAi agent comprising an amine-comprising linker, for example, (NH2-C6) (see table 11). In some embodiments, the amine-comprising linker may be located on the 5' end of the sense strand or the antisense strand of a SOD1 RNAi agent. In some embodiments, the amine-comprising linker may be located on the 3' end of the sense strand or the antisense strand of an RNAi agent.

In some embodiments, an RNAi agent comprising an amine-comprising linker, such as (NH2-C6) or (NH2-C6)s, may be reacted with a lipid comprising an activated ester moiety. Example lipids with activated ester moieties include LP183-p, LP 283-p, LP293-p, LP304-p, LP310-p, LP383-p, LP395-p, and LP396-p as shown in Table 11 below.

In some embodiments, a SOD1 RNAi agent may be conjugated to a lipid moiety using phosphoramidite synthesis. Synthesizing oligonucleotides using phosphoramidites is well-known in the art. In some embodiments, a lipid moiety may be conjugated to the 5' end of the sense strand or the antisense strand of a SOD1 RNAi agent using a phosphoramidite. In some embodiments, a lipid moiety may be conjugated to the 3' end of the sense strand or the antisense strand of a SOD1 RNAi agent using a phosphoramidite. In some embodiments, a phosphoramidite selected from (2C8C12)-p, (2C6C10)-p, LP429 phosphoramidite, HO—C16-p, C16-p, or C22-p, all as shown in Table 11 below, may be used to conjugate a lipid moiety to a SOD1 RNAi agent.

In some embodiments, SOD1 RNAi agents may comprise a lipid moiety on an internal nucleotide (i.e., not on the 3' or 5' terminal nucleotides.) In some embodiments, an internal nucleotide may be linked to the 2' position of ribose. In some embodiments SOD1 RNAi agents may comprise aC16, uC16, cC16, or gC16 as shown in Table 11 below.

Any of the SOD1 RNAi agent nucleotide sequences listed in Tables 2, 3, 4, 5, 6, and 10, whether modified or unmodified, can contain 3' and/or 5' targeting group(s), linking group(s), and/or lipid PK/PD moieties. Any of the SOD1 RNAi agent sequences listed in Tables 3, 4, 5, 6, and 10, or are otherwise described herein, which contain a 3' or 5' targeting group, linking group, and/or lipid PK/PD moiety can alternatively contain no 3' or 5' targeting group, linking group, or lipid PK/PD moiety, or can contain a different 3' or 5' targeting group, linking group, or lipid PK/PD moiety including, but not limited to, those depicted in Table 11. Any of the SOD1 RNAi agent duplexes listed in Tables 7A, 7B, 8, 9A and 10, whether modified or unmodified, can further comprise a targeting group, linking group, or PK/PD moiety including, but not limited to, those depicted in Table 11, and the targeting group, linking group or PK/PD moiety can be attached to the 3' or 5' terminus of either the sense strand or the antisense strand of the SOD1 RNAi agent duplex.

Examples of certain modified nucleotides, capping moieties, lipid moieties, and linking groups are provided in Table 11.

TABLE 11
Structures Representing Various Modified Nucleotides, Capping Moieties, lipid PK/PD moieties and Linking Groups (wherein ⌇ indicates the point of connection)
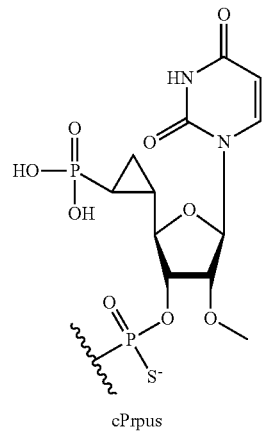
cPrpus
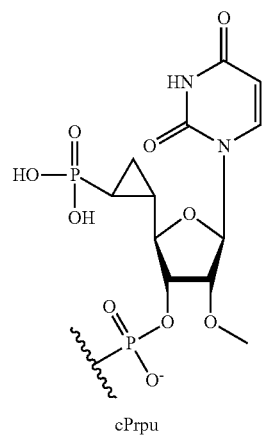
cPrpu
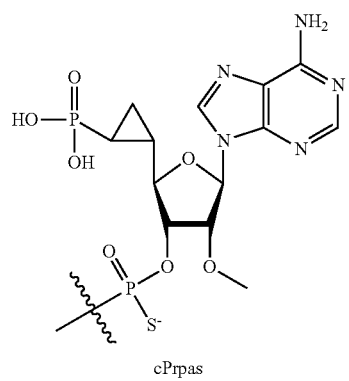
cPrpas TABLE 11-continued
Structures Representing Various Modified Nucleotides, Capping Moieties, lipid PK/PD moieties and Linking Groups (wherein ⁂ indicates the point of connection)
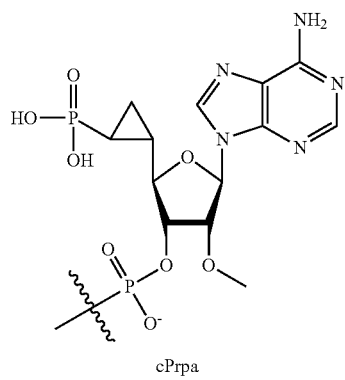
cPrpa
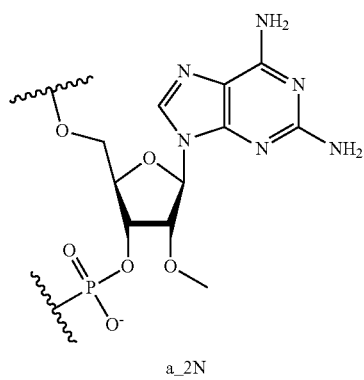
a_2N
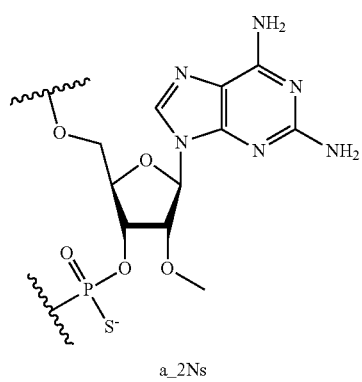
a_2Ns
When positioned internally:
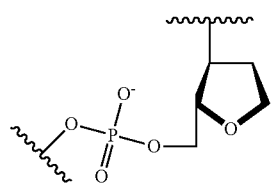
(invAb)

TABLE 11-continued

Structures Representing Various Modified Nucleotides, Capping Moieties, lipid PK/PD moieties and Linking Groups (wherein ⧚ indicates the point of connection)

When positioned internally:

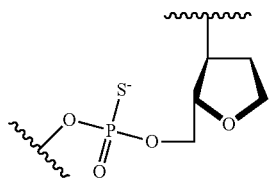

linkage towards 5' end linkage towards 3' end (invAb)s

When positioned at the 3' terminal end:

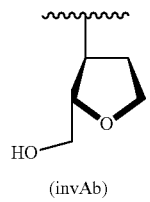

linkage towards 5' end (invAb)

When positioned at the 3' terminal end:

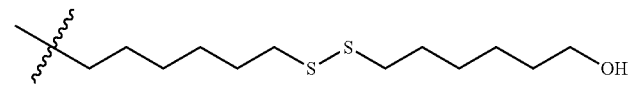

linkage towards 5' end (C6-SS-C6)

When positioned internally:

linkage towards 5' end          linkage towards 3' end

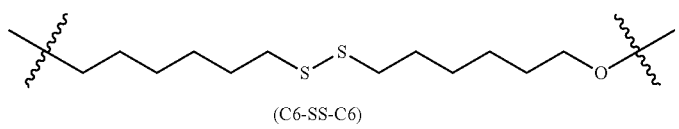

(C6-SS-C6)

When positioned at the 3' terminal end:

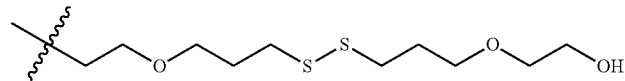

linkage towards 5' end (6-SS-6)

TABLE 11-continued
Structures Representing Various Modified Nucleotides, Capping Moieties, lipid PK/PD moieties and Linking Groups (wherein ⌇ indicates the point of connection)
When positioned internally:
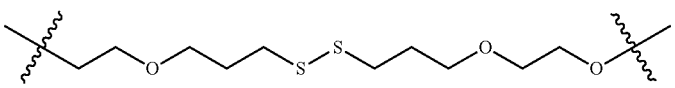
linkage towards 5' end            linkage towards 3' end
(6-SS-6)
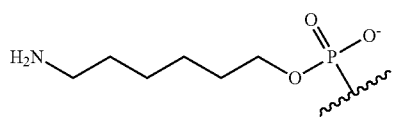
(NH2-C6)
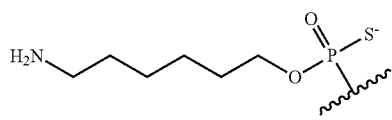
(NH2-C6)s
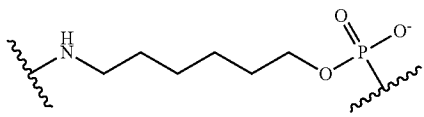
(NH-C6)
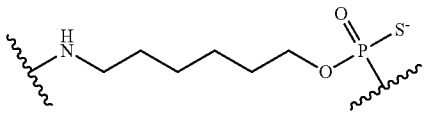
(NH-C6)s
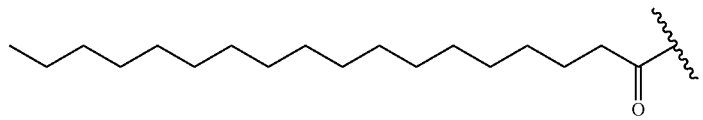
LP128
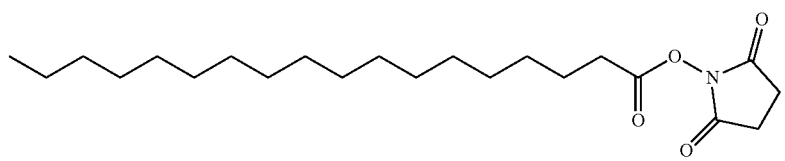
LP128-p
Purchased from Santa Cruz #sc-219228
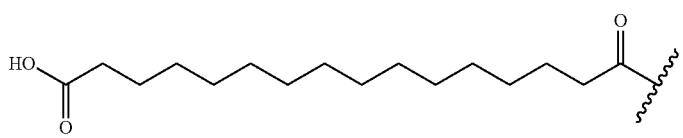
LP132

TABLE 11-continued
Structures Representing Various Modified Nucleotides, Capping Moieties, lipid PK/PD moieties and Linking Groups (wherein ⌇ indicates the point of connection)
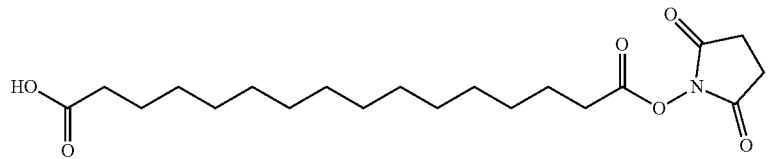
LP132-p
Commercially available
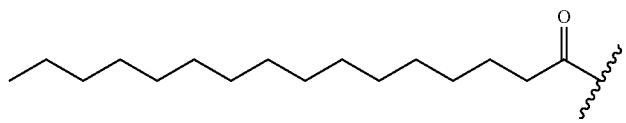
LP183
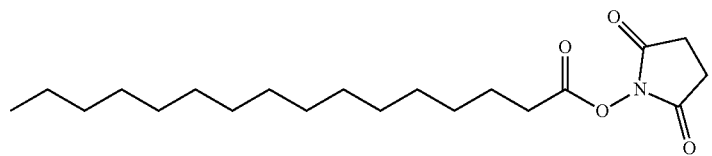
LP183-p (Sigma)
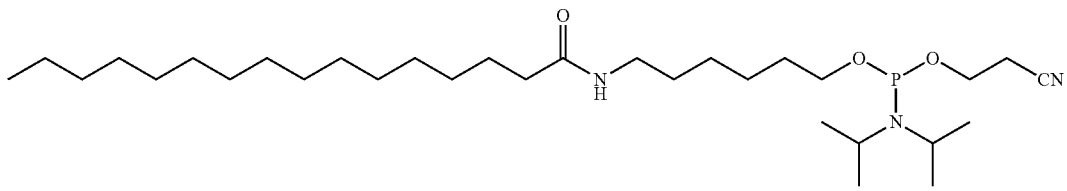
LP183 phosphoramidite
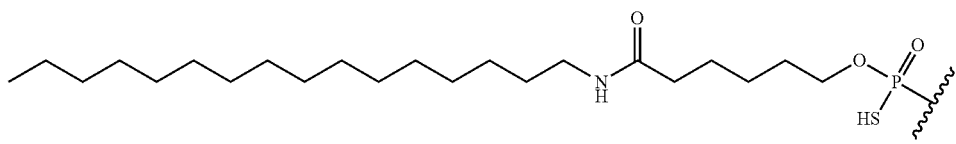
LP183rs
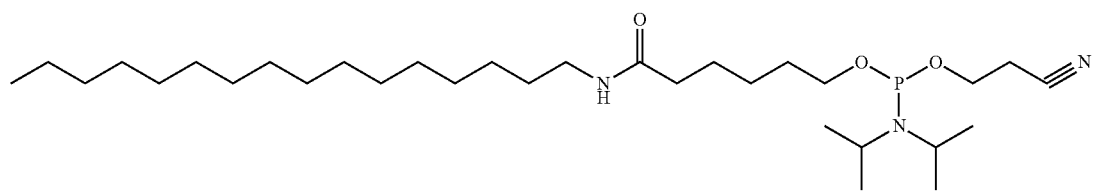
LP183r-p
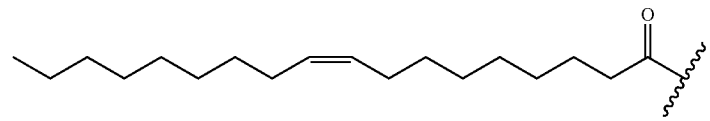
LP200

TABLE 11-continued
Structures Representing Various Modified Nucleotides, Capping Moieties, lipid PK/PD moieties and Linking Groups (wherein ⌇ indicates the point of connection)
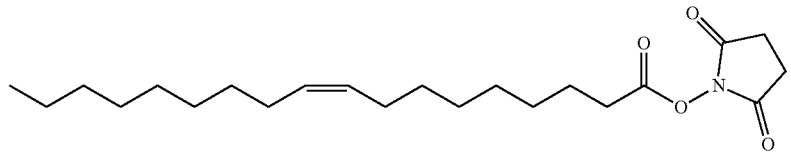
LP200-p
(Commercially available)
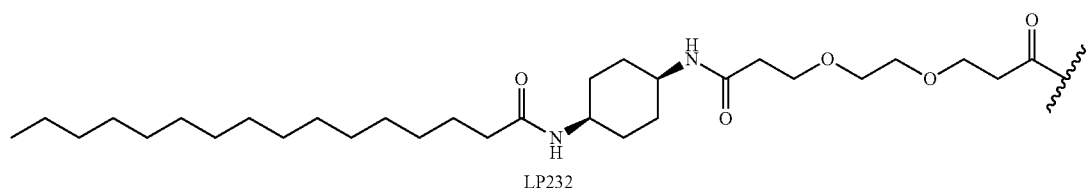 [SMILES: *C(=O)CCOCCOCCC(=O)N[C@H]1CC[C@@H](NC(=O)CCCCCCCCCCCCCCC)CC1]
LP232
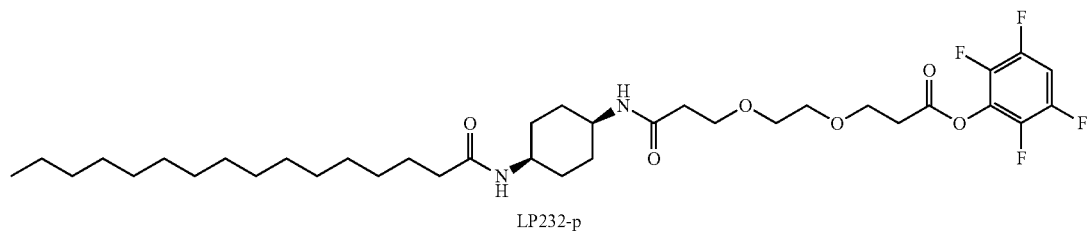 [SMILES: CCCCCCCCCCCCCCCC(=O)N[C@H]1CC[C@@H](NC(=O)CCOCCOCCC(=O)Oc2c(F)c(F)cc(F)c2F)CC1]
LP232-p
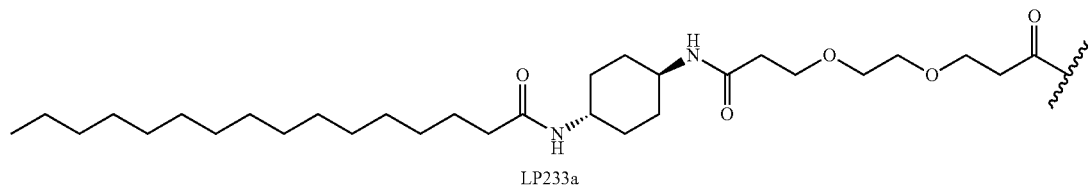 [SMILES: *C(=O)CCOCCOCCC(=O)N[C@H]1CC[C@H](NC(=O)CCCCCCCCCCCCCCC)CC1]
LP233a
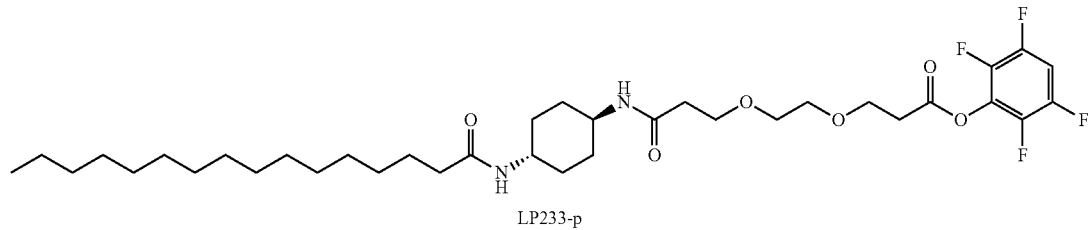 [SMILES: CCCCCCCCCCCCCCCC(=O)N[C@H]1CC[C@H](NC(=O)CCOCCOCCC(=O)Oc2c(F)c(F)cc(F)c2F)CC1]
LP233-p
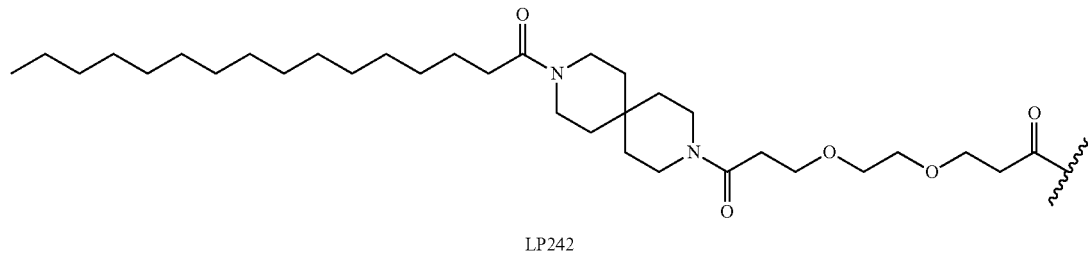 [SMILES: *C(=O)CCOCCOCCC(=O)N1CCC2(CCN(C(=O)CCCCCCCCCCCCCCC)CC2)CC1]
LP242

TABLE 11-continued
Structures Representing Various Modified Nucleotides, Capping Moieties, lipid PK/PD moieties and Linking Groups (wherein ⸹ indicates the point of connection)
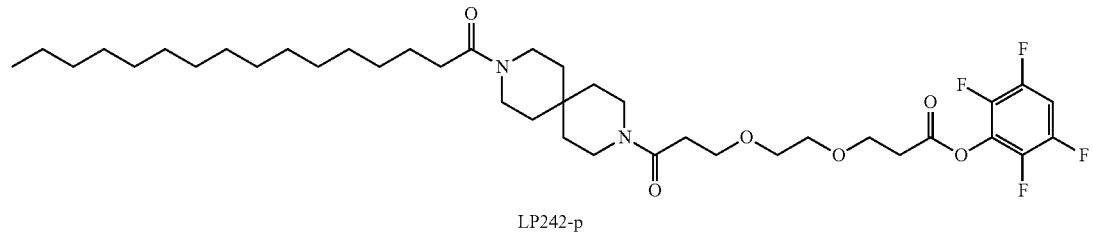 [SMILES: CCCCCCCCCCCCCCCC(=O)N1CCC2(CC1)CCN(C(=O)CCOCCOCCC(=O)Oc1c(F)c(F)cc(F)c1F)CC2]
LP242-p
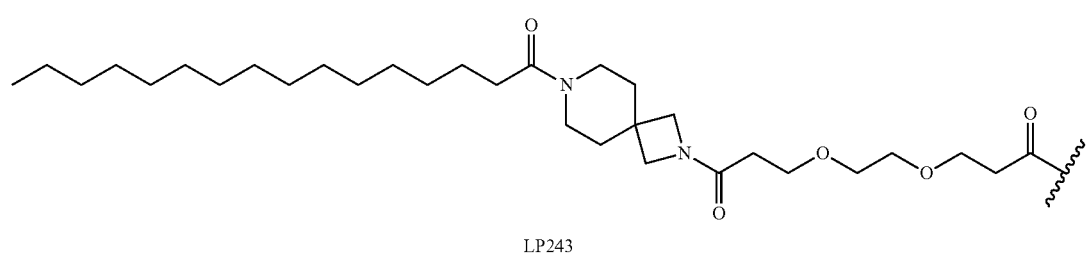 [SMILES: *C(=O)CCOCCOCCC(=O)N1CC2(CCN(C(=O)CCCCCCCCCCCCCCC)CC2)C1]
LP243
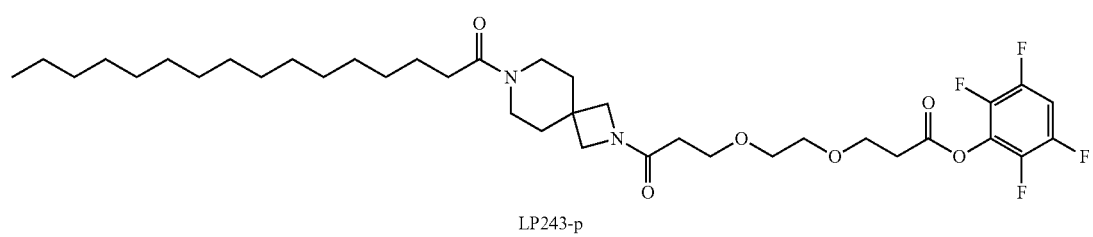 [SMILES: CCCCCCCCCCCCCCCC(=O)N1CCC2(CC1)CN(C(=O)CCOCCOCCC(=O)Oc1c(F)c(F)cc(F)c1F)C2]
LP243-p
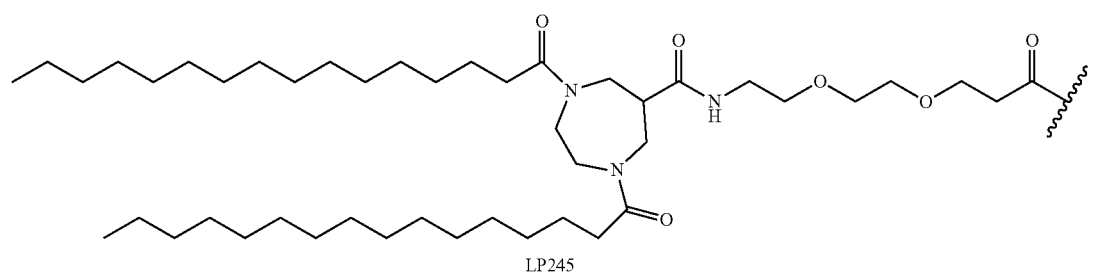 [SMILES: *C(=O)CCOCCOCCNC(=O)C1CN(C(=O)CCCCCCCCCCCCCCC)CCN(C(=O)CCCCCCCCCCCCCCC)C1]
LP245
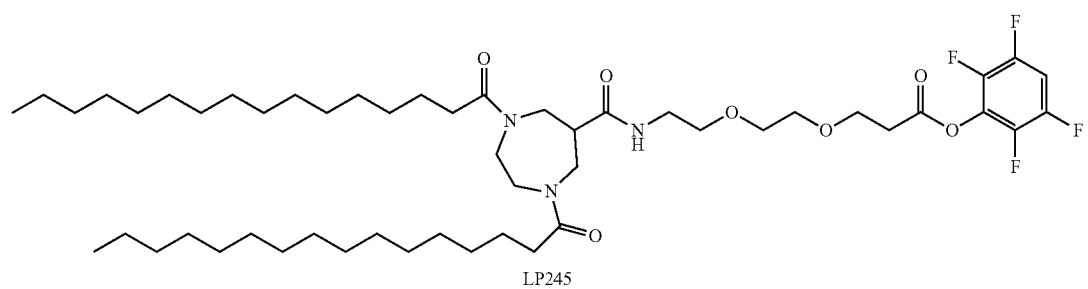 [SMILES: CCCCCCCCCCCCCCCC(=O)N1CCN(C(=O)CCCCCCCCCCCCCCC)CC(C(=O)NCCOCCOCCC(=O)Oc2c(F)c(F)cc(F)c2F)C1]
LP245
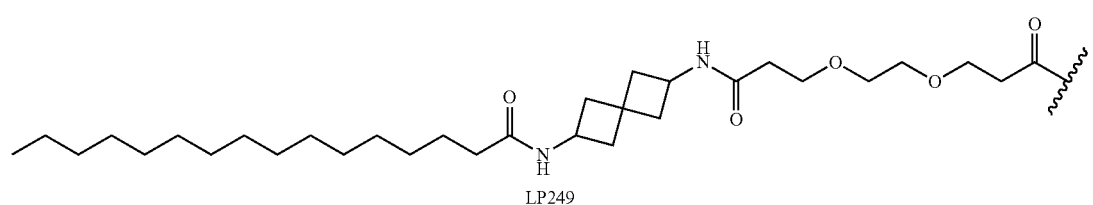 [SMILES: *C(=O)CCOCCOCCC(=O)NC1CC2(CC(NC(=O)CCCCCCCCCCCCCCC)C2)C1]
LP249

TABLE 11-continued
Structures Representing Various Modified Nucleotides, Capping Moieties, lipid PK/PD moieties and Linking Groups (wherein ⁀ indicates the point of connection)
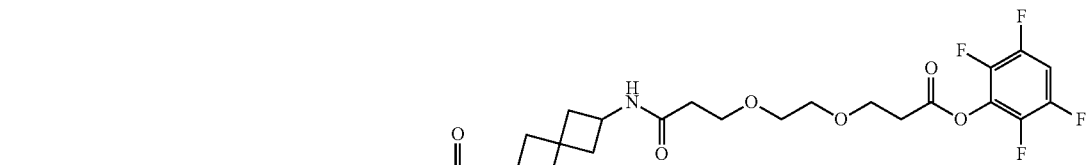
LP249-p
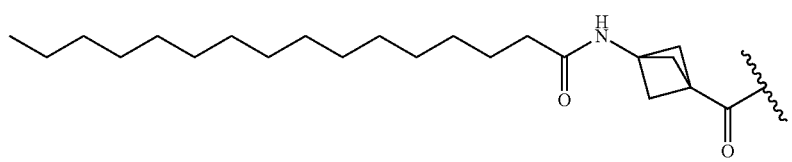
LP257
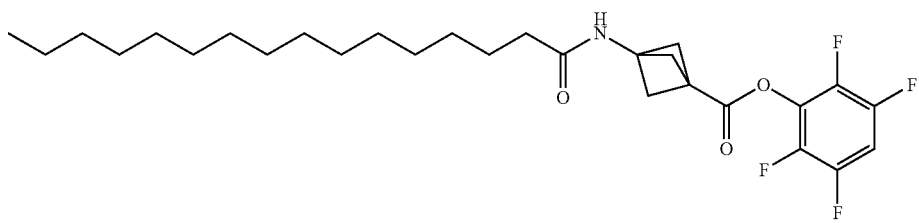
LP257-p
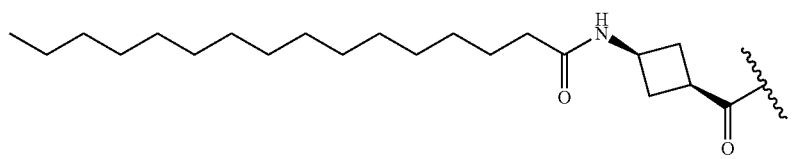
LP259
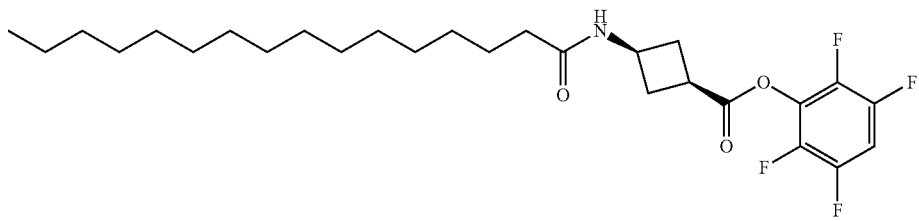
LP259-p
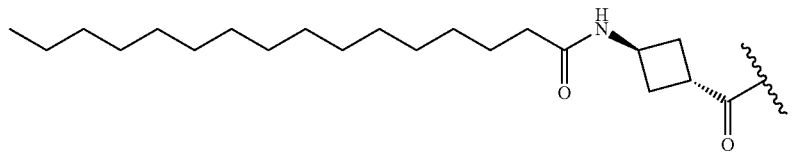
LP260

TABLE 11-continued
Structures Representing Various Modified Nucleotides, Capping Moieties, lipid PK/PD moieties and Linking Groups (wherein ⸸ indicates the point of connection)
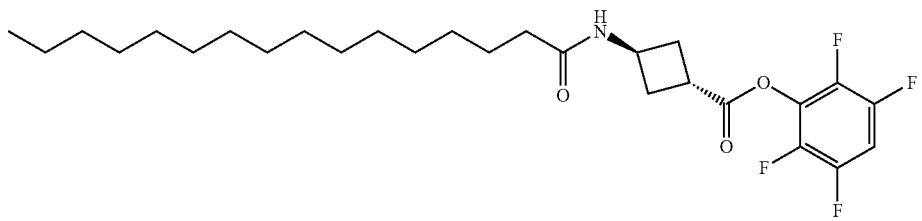
LP260-p
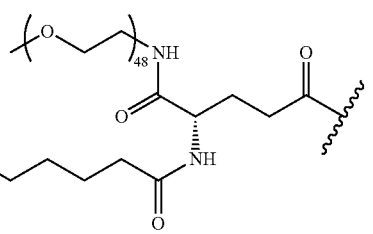
LP262
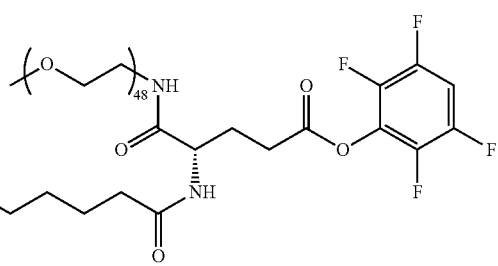
LP262-p
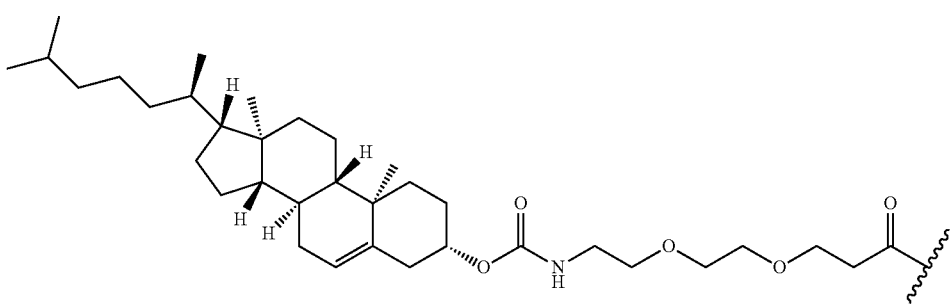
LP269
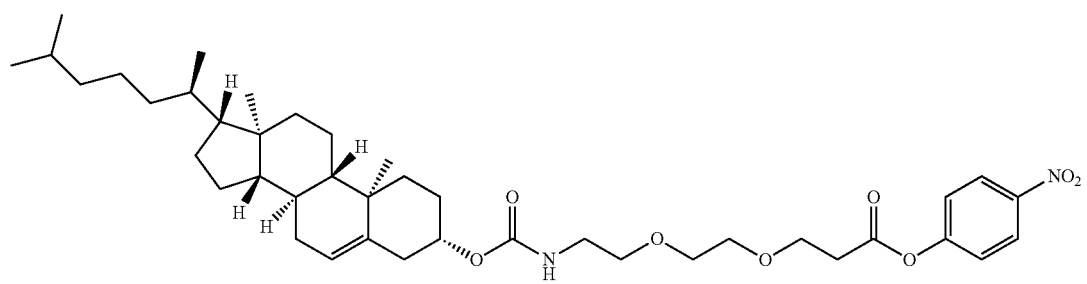
LP269-p TABLE 11-continued
Structures Representing Various Modified Nucleotides, Capping Moieties, lipid PK/PD moieties and Linking Groups (wherein ⌇ indicates the point of connection)
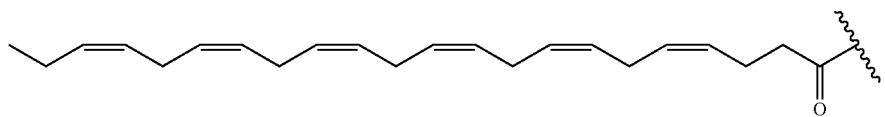
LP273
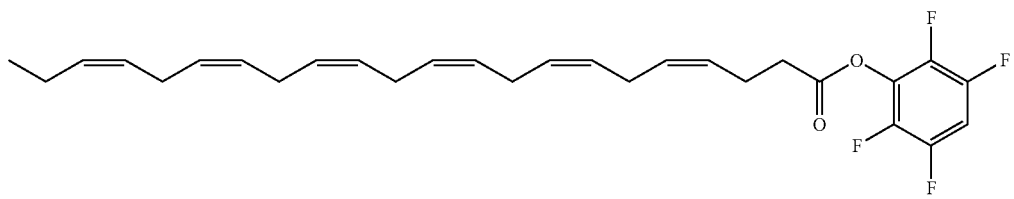
LP273-p
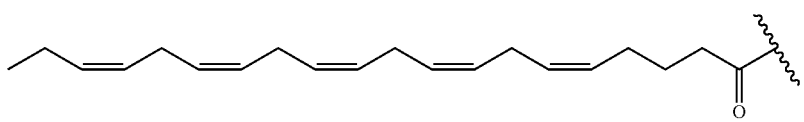
LP274
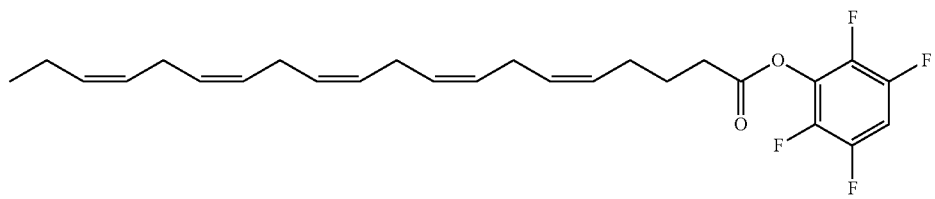
LP274-p
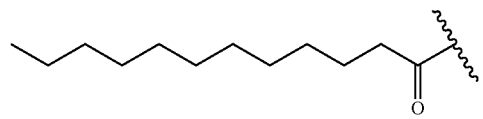
LP276
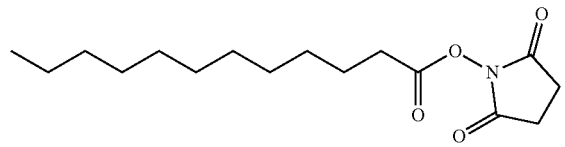
LP276-p
(Commercially available)
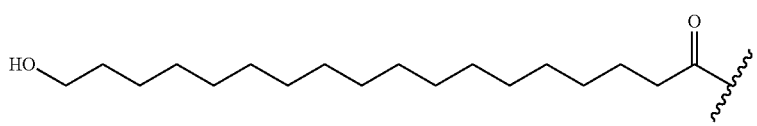
LP283

TABLE 11-continued
Structures Representing Various Modified Nucleotides, Capping Moieties, lipid PK/PD moieties and Linking Groups (wherein ⁂ indicates the point of connection)
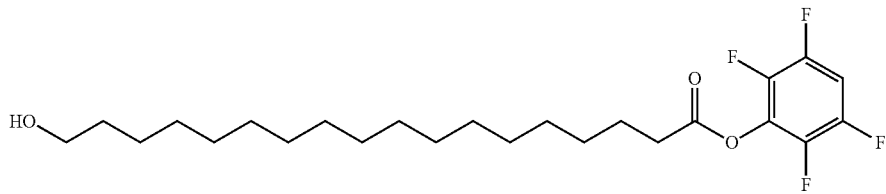
LP283-p
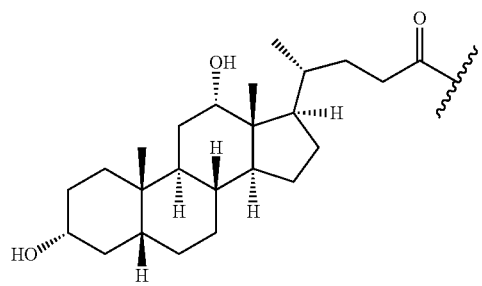
LP286
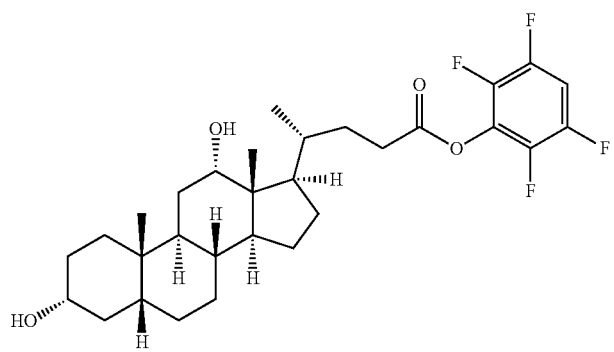
LP286-p
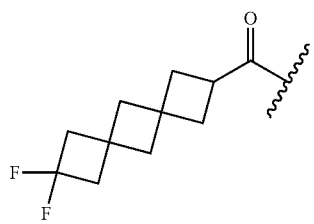
LP287
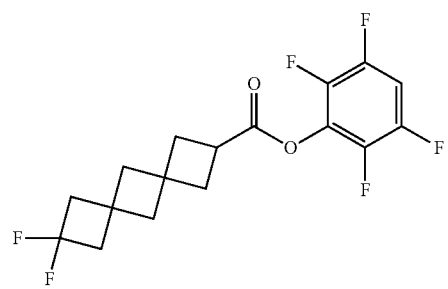
LP287-p TABLE 11-continued
Structures Representing Various Modified Nucleotides, Capping Moieties, lipid PK/PD moieties and Linking Groups (wherein ⌇ indicates the point of connection)
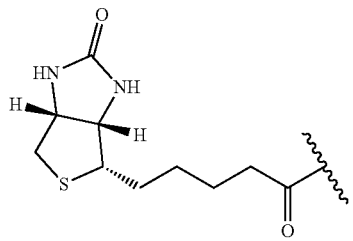
LP289
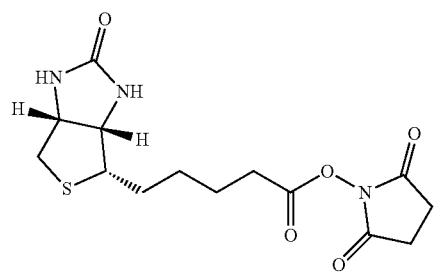
LP289-p
(Commercially available)
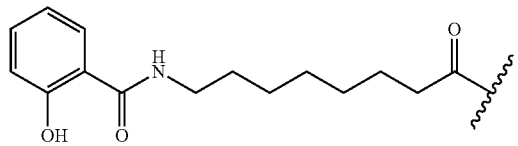
LP290
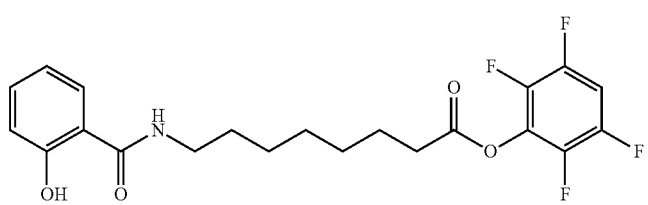
LP290-p
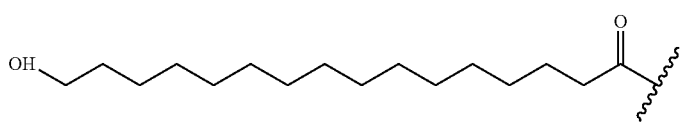
LP293
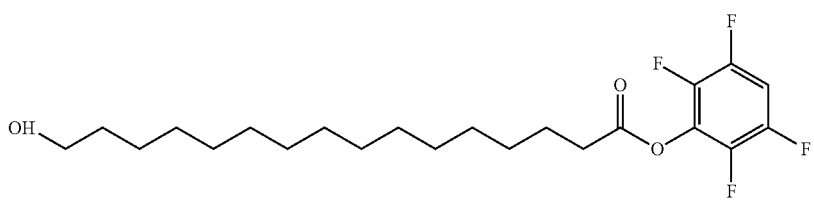
LP293-p 121 122
TABLE 11-continued
Structures Representing Various Modified Nucleotides, Capping Moieties, lipid PK/PD moieties and Linking Groups (wherein ⌇ indicates the point of connection)
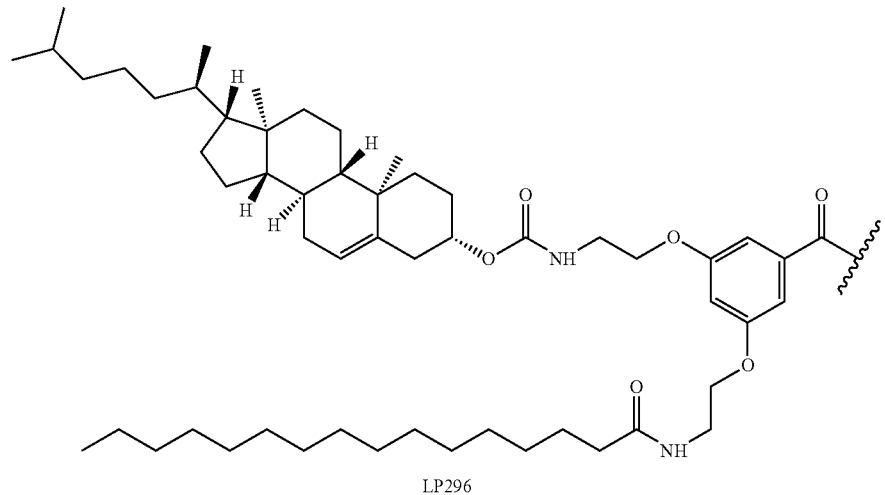 [SMILES: *C(=O)c1cc(OCCNC(=O)CCCCCCCCCCCCCCC)cc(OCCNC(=O)O[C@H]2CC[C@@]3(C)C(=CC[C@H]4[C@@H]5CC[C@H]([C@H](C)CCCC(C)C)[C@@]5(C)CC[C@@H]43)C2)c1]
LP296
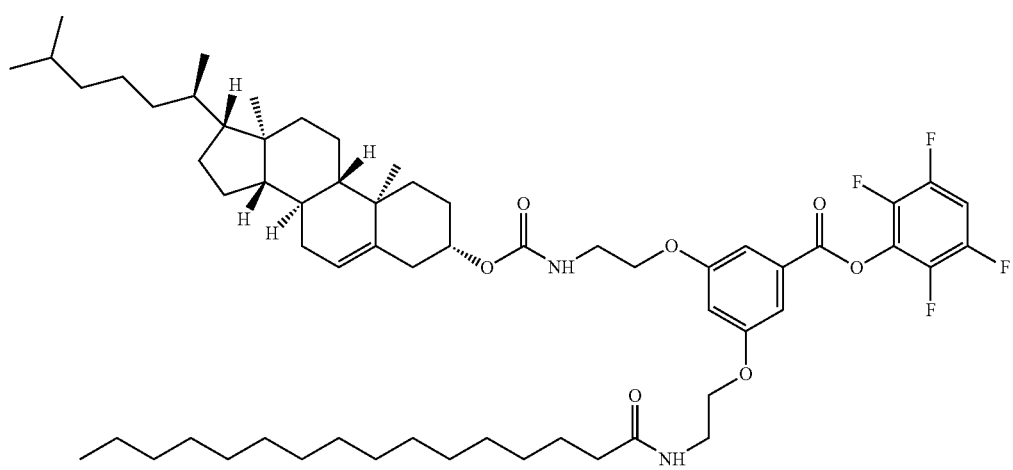
LP296-p
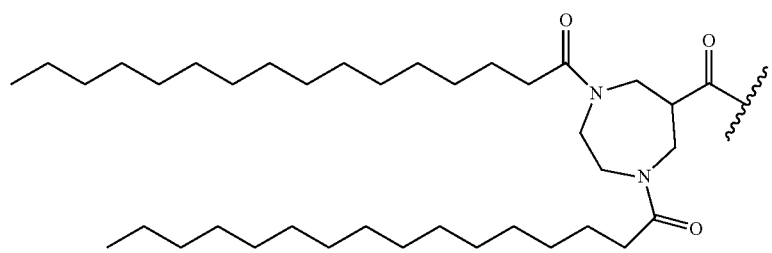
LP300

TABLE 11-continued
Structures Representing Various Modified Nucleotides, Capping Moieties, lipid PK/PD moieties and Linking Groups (wherein ⁂ indicates the point of connection)
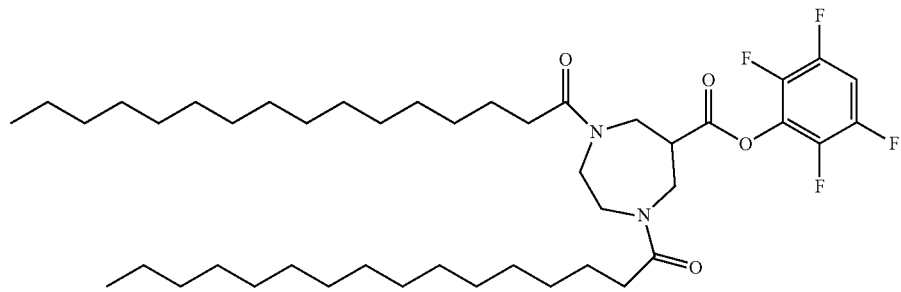
LP300-p
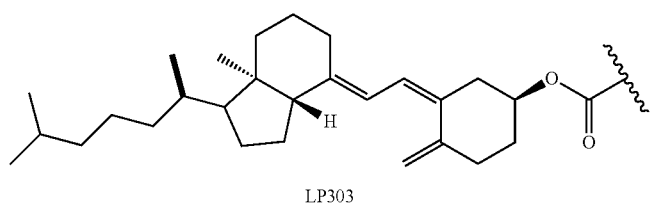 [SMILES: *C(=O)O[C@H]1CCC(=C)/C(=C\C=C2/CCC[C@]3(C)C([C@H](C)CCCC(C)C)CC[C@@H]23)C1]
LP303
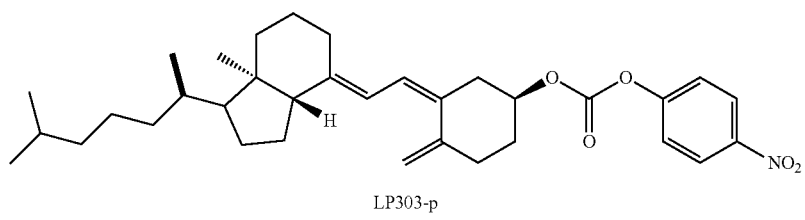 [SMILES: C=C1CC[C@H](OC(=O)Oc2ccc([N+](=O)[O-])cc2)C/C1=C/C=C1\CCC[C@]2(C)C([C@H](C)CCCC(C)C)CC[C@@H]12]
LP303-p
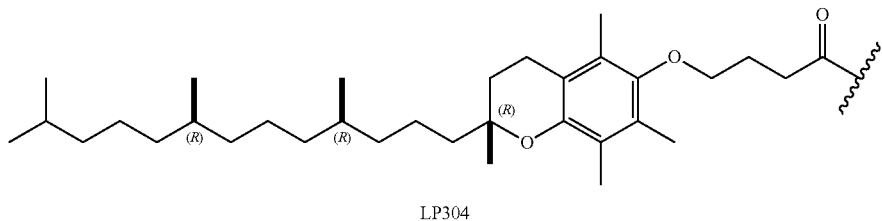
LP304
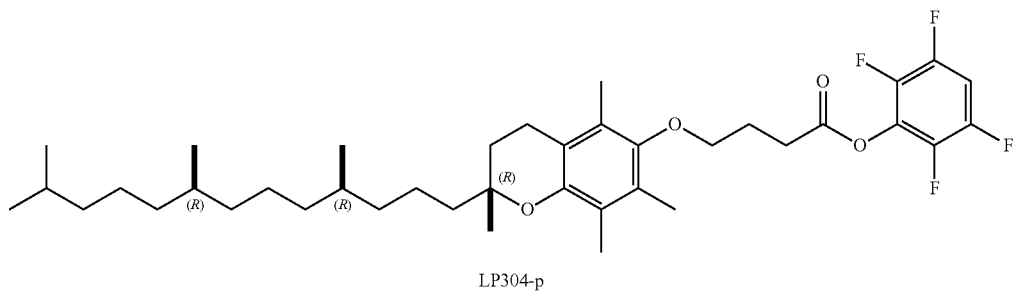
LP304-p
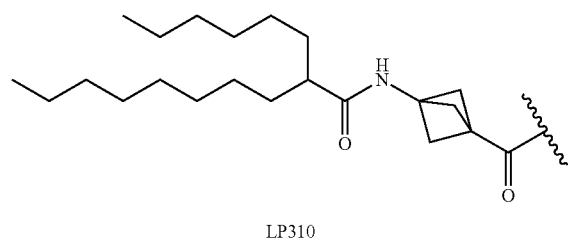 [SMILES: *C(=O)C12CC(NC(=O)C(CCCCCC)CCCCCCCC)(C1)C2]
LP310

TABLE 11-continued
Structures Representing Various Modified Nucleotides, Capping Moieties, lipid PK/PD moieties and Linking Groups (wherein ⌇ indicates the point of connection)
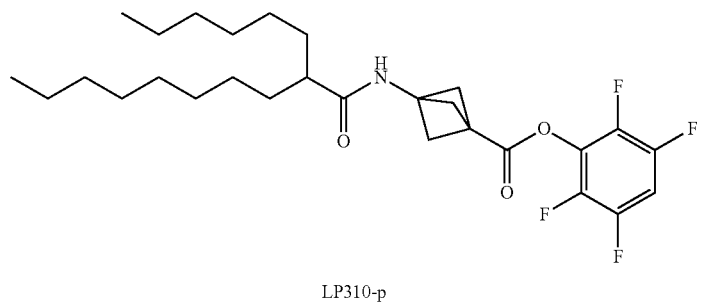 [SMILES: CCCCCCCCC(CCCCCC)C(=O)NC12CC(C(=O)Oc3c(F)c(F)cc(F)c3F)(C1)C2]
LP310-p
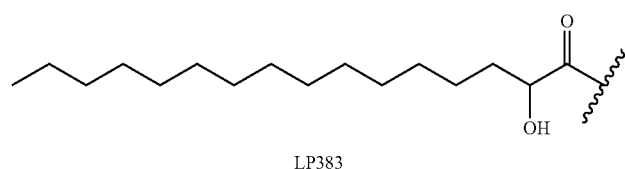 [SMILES: *C(=O)C(O)CCCCCCCCCCCCCC]
LP383
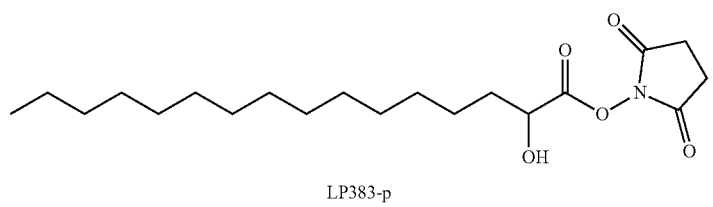 [SMILES: CCCCCCCCCCCCCCC(O)C(=O)ON1C(=O)CCC1=O]
LP383-p
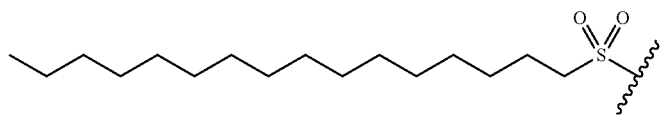
LP395
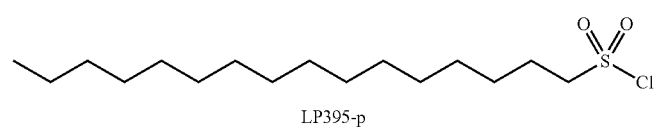 [SMILES: CCCCCCCCCCCCCCCCS(=O)(=O)Cl]
LP395-p
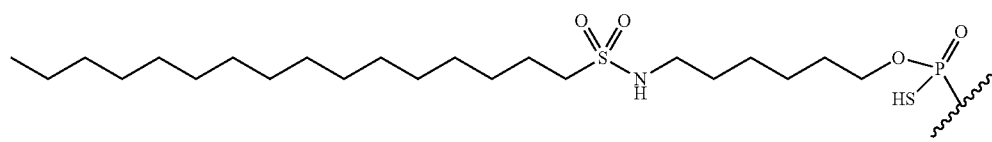
LP395s
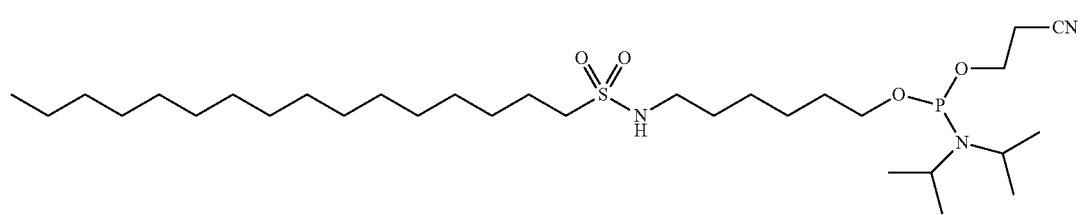
LP395 phosphoramidite TABLE 11-continued
Structures Representing Various Modified Nucleotides, Capping Moieties, lipid PK/PD moieties and Linking Groups (wherein ⁅ indicates the point of connection)
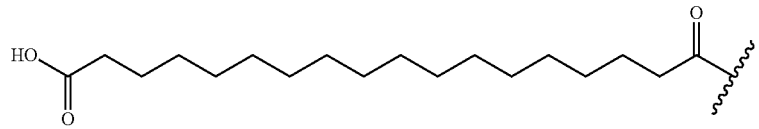
LP396
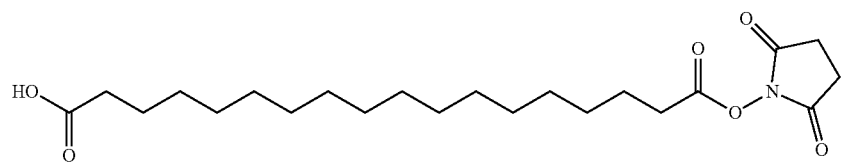
LP396-p
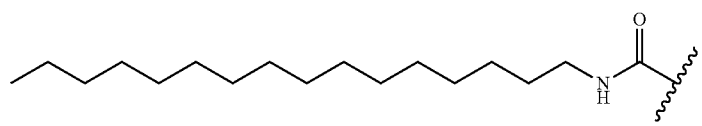
LP409
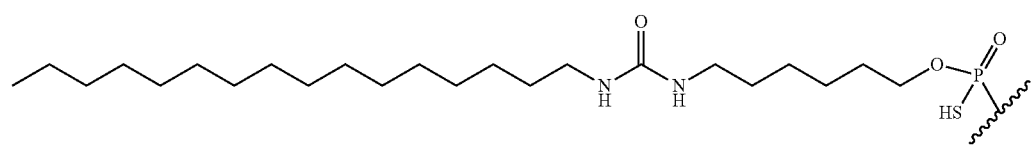
LP409s
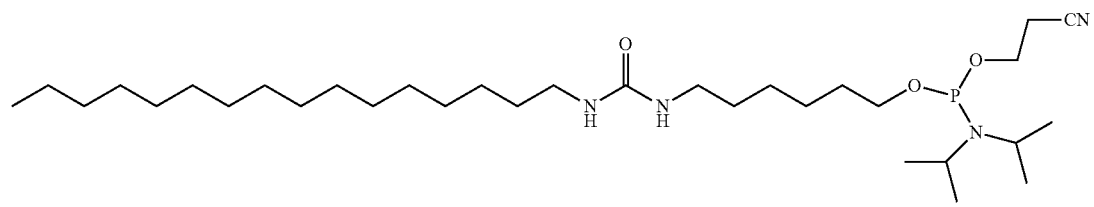
LP409 phosphoramidite
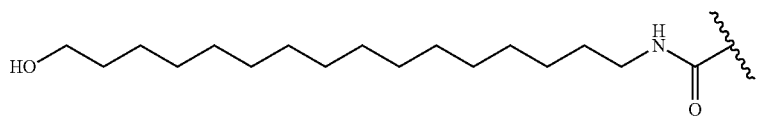
LP429
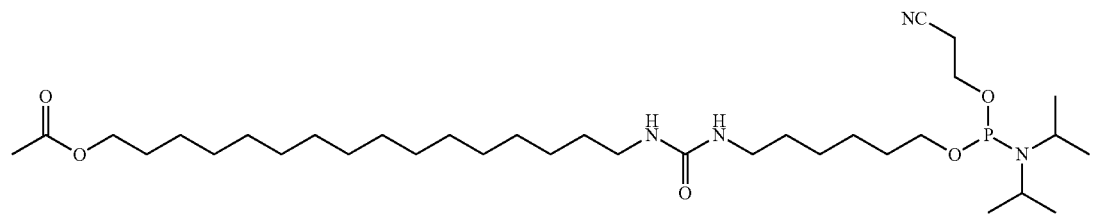
LP429-p
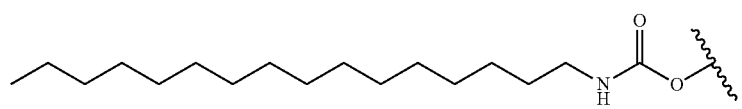
LP430

TABLE 11-continued
Structures Representing Various Modified Nucleotides, Capping Moieties, lipid PK/PD moieties and Linking Groups (wherein ⸹ indicates the point of connection)
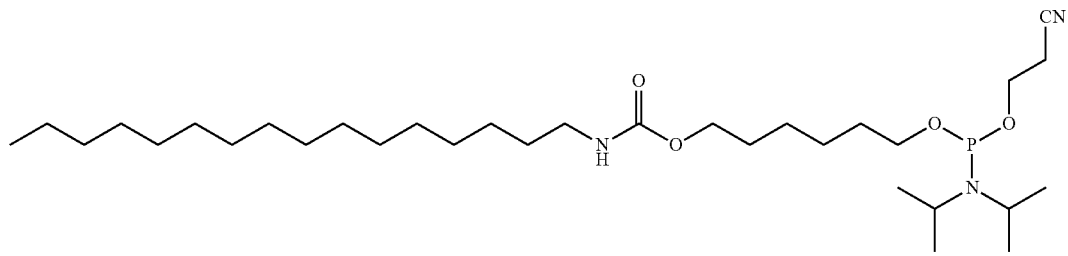
LP430-p
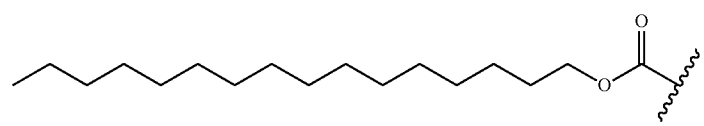
LP431
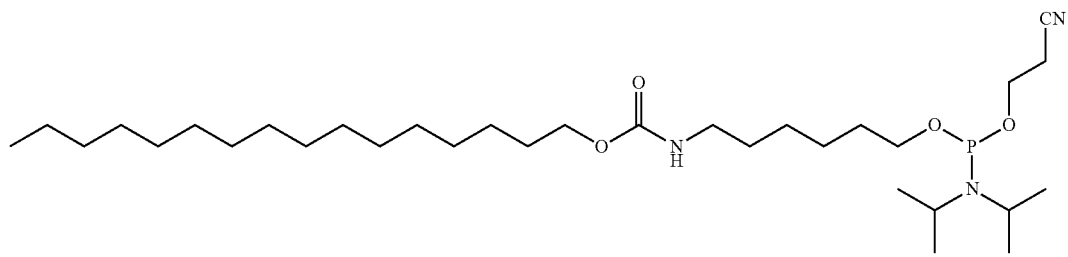
LP431-p
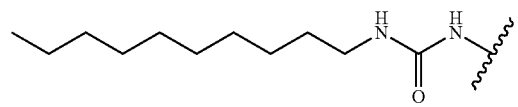
LP435
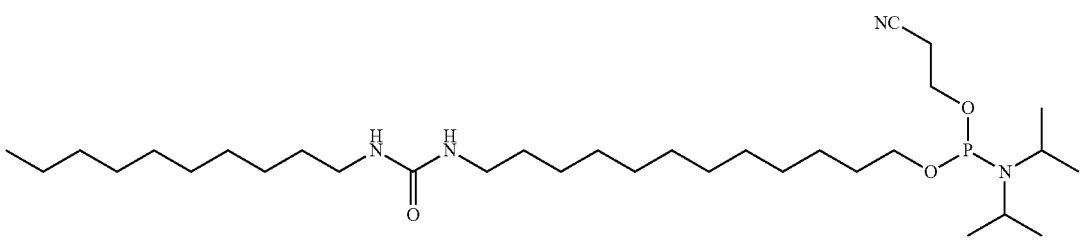
LP435-p
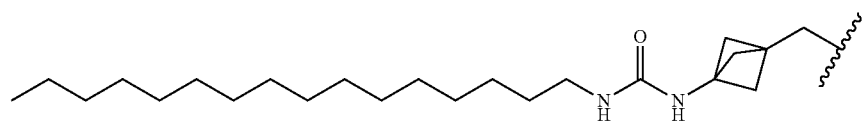
LP439

TABLE 11-continued
Structures Representing Various Modified Nucleotides, Capping Moieties, lipid PK/PD moieties and Linking Groups (wherein ⸲ indicates the point of connection)
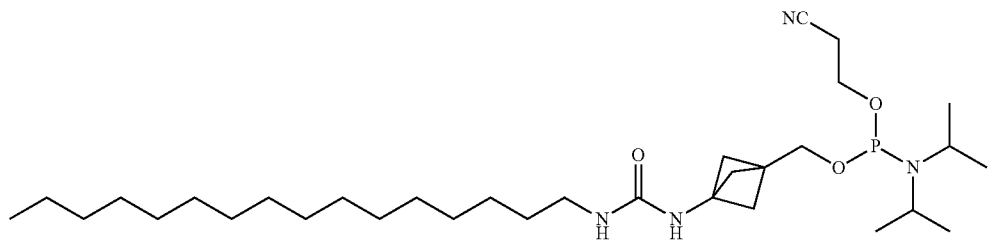
LP439-p
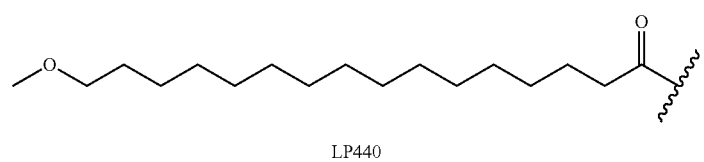 [SMILES: *C(=O)CCCCCCCCCCCCCCCOC]
LP440
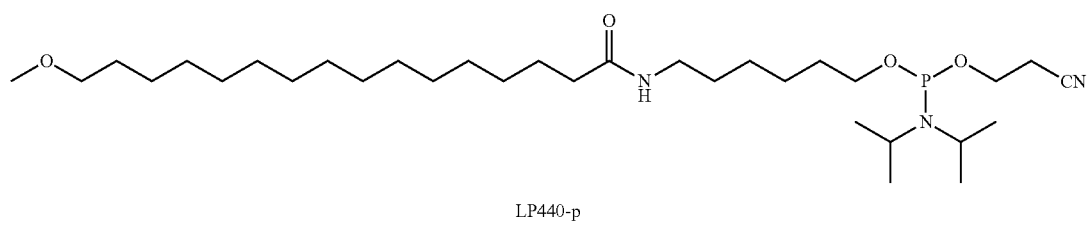 [SMILES: COCCCCCCCCCCCCCCCC(=O)NCCCCCCOP(OCCC#N)N(C(C)C)C(C)C]
LP440-p
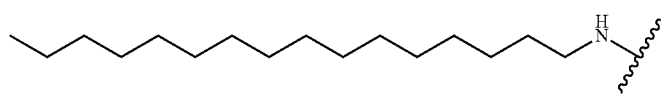
LP441
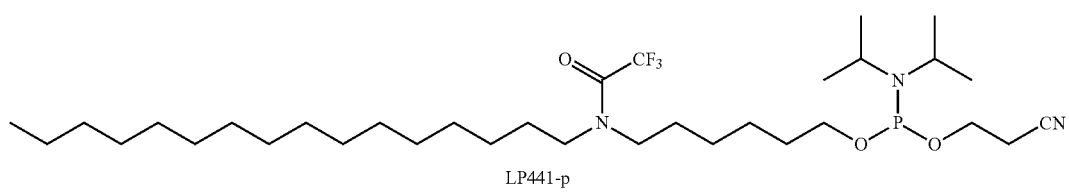 [SMILES: CCCCCCCCCCCCCCCCN(CCCCCCOP(OCCC#N)N(C(C)C)C(C)C)C(=O)C(F)(F)F]
LP441-p
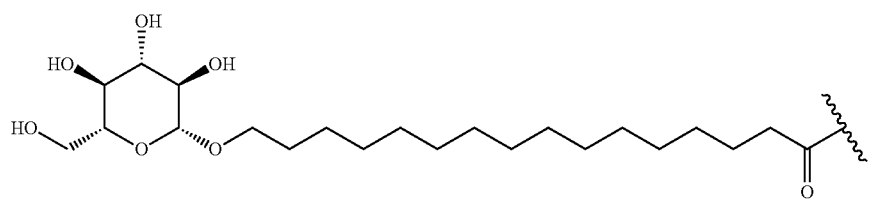
LP456
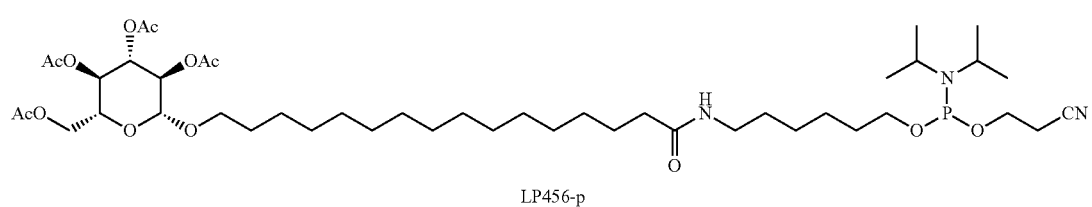 [SMILES: CC(=O)OC[C@H]1O[C@@H](OCCCCCCCCCCCCCCCC(=O)NCCCCCCOP(OCCC#N)N(C(C)C)C(C)C)[C@H](OC(C)=O)[C@@H](OC(C)=O)[C@@H]1OC(C)=O]
LP456-p 133 134
TABLE 11-continued
Structures Representing Various Modified Nucleotides, Capping Moieties, lipid PK/PD moieties and Linking Groups (wherein ⌇ indicates the point of connection)
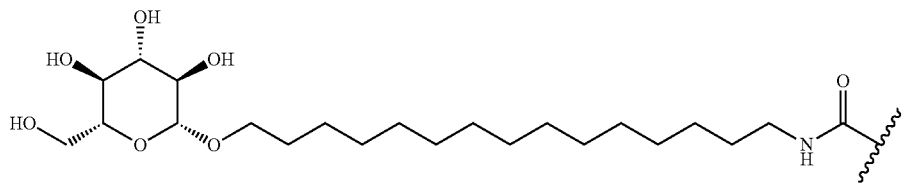
LP462
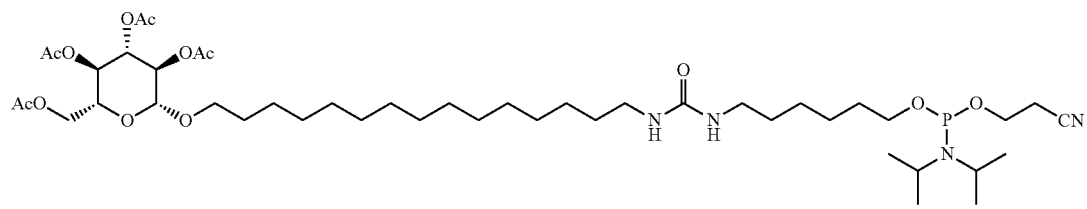
LP462-p
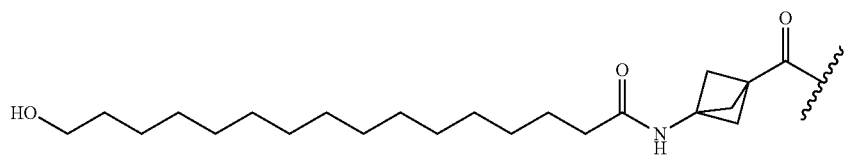
LP463
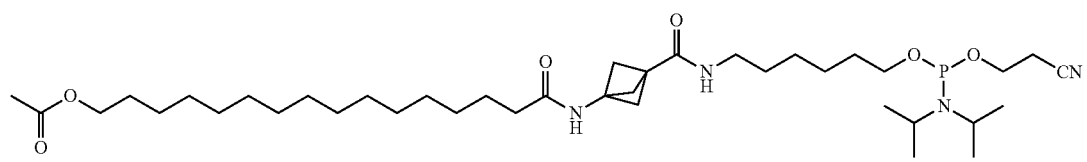
LP463-p
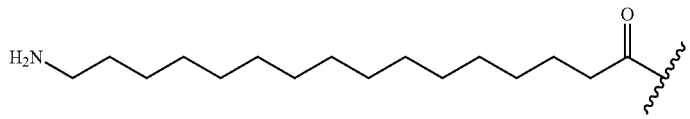
LP464
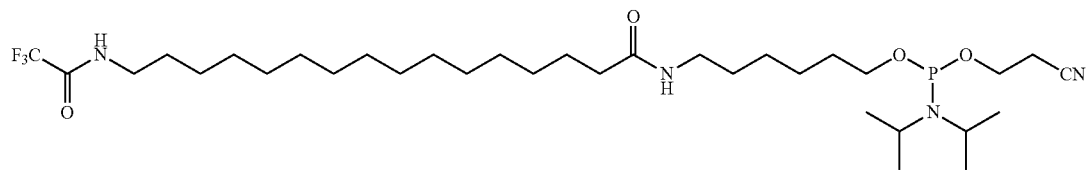
LP464-p
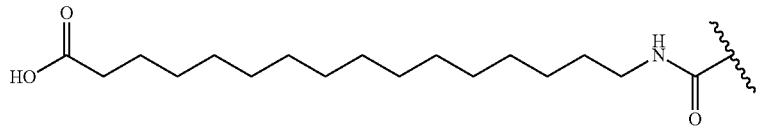
LP465

TABLE 11-continued
Structures Representing Various Modified Nucleotides, Capping Moieties, lipid PK/PD moieties and Linking Groups (wherein ⁀ indicates the point of connection)
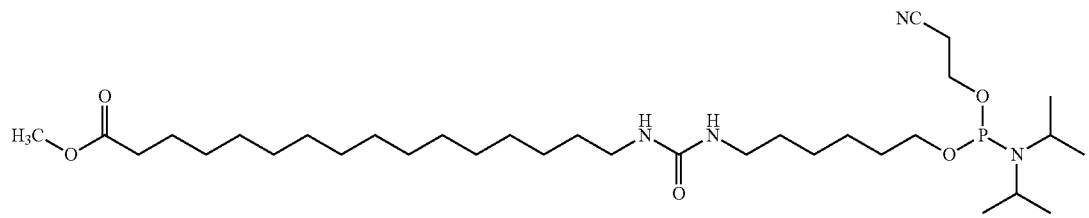
LP465-p
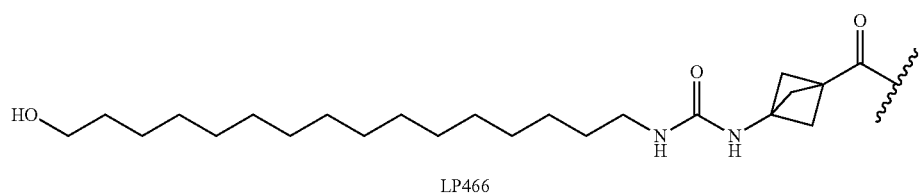 [SMILES: *C(=O)C12CC(NC(=O)NCCCCCCCCCCCCCCCCO)(C1)C2]
LP466
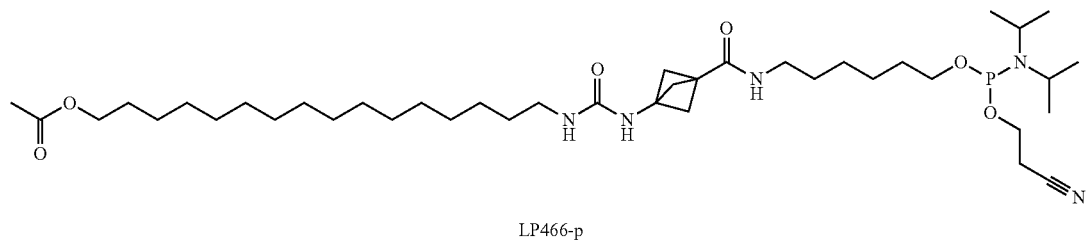 [SMILES: CC(=O)OCCCCCCCCCCCCCCCCNC(=O)NC12CC(C(=O)NCCCCCCOP(OCCC#N)N(C(C)C)C(C)C)(C1)C2]
LP466-p
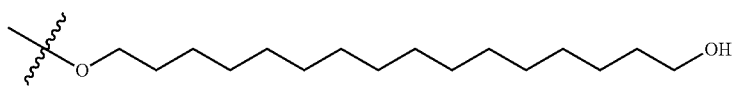
LP493a (2' internal)
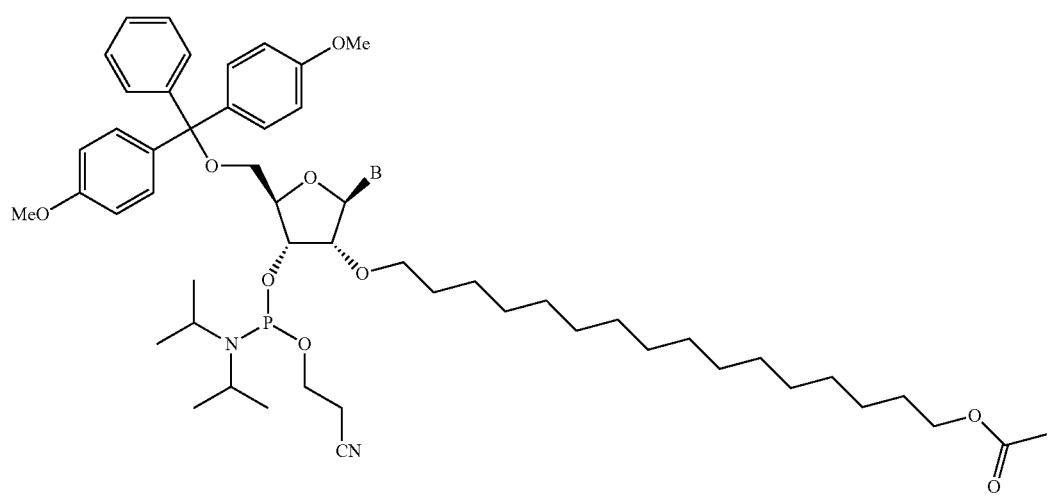
LP493-p (2' internal) (wherein B is a nucleobase)

TABLE 11-continued
Structures Representing Various Modified Nucleotides, Capping Moieties, lipid PK/PD moieties and Linking Groups (wherein ⁓ indicates the point of connection)
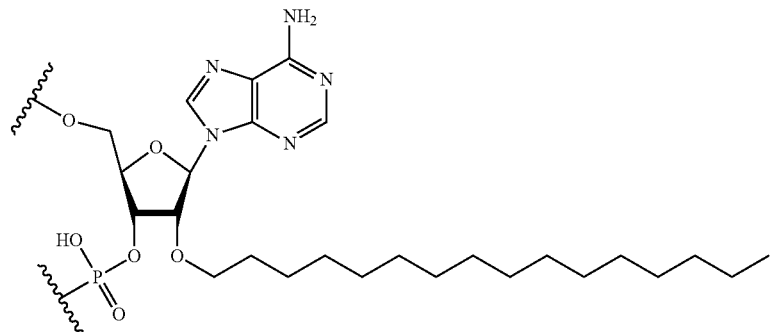
aC16
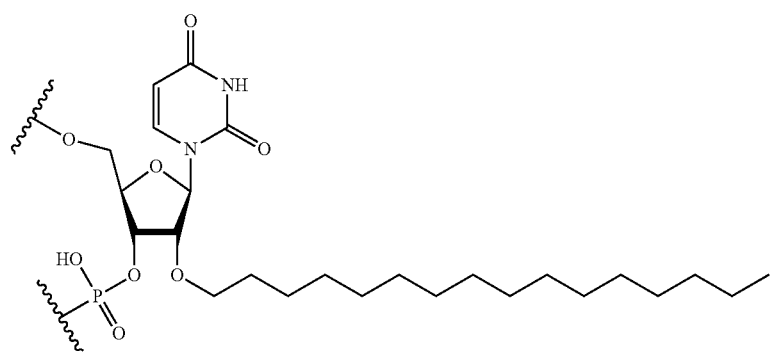
uC16
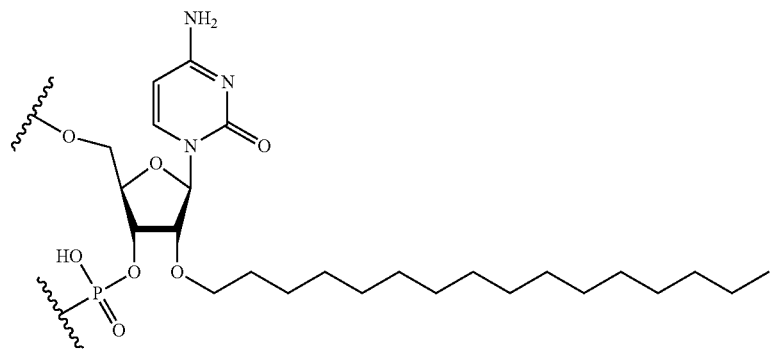
cC16
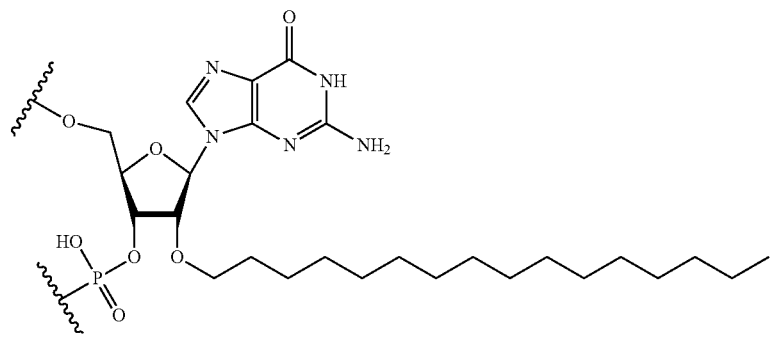
gC16

TABLE 11-continued
Structures Representing Various Modified Nucleotides, Capping Moieties, lipid PK/PD moieties and Linking Groups (wherein ⧸ indicates the point of connection)
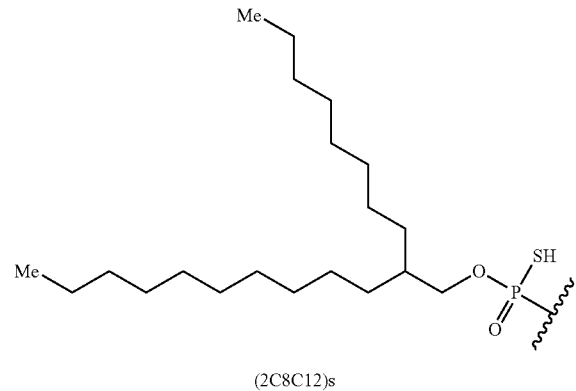
(2C8C12)s
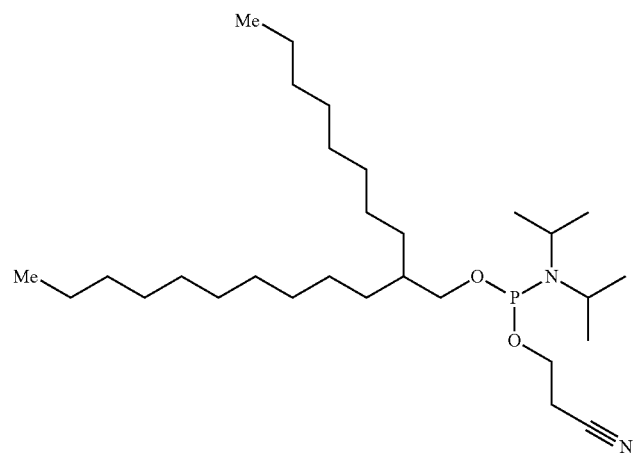
(2C8C12)-p
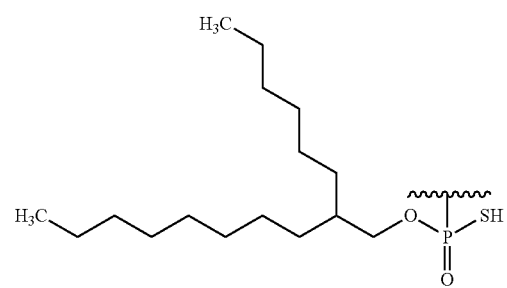
(2C6C10)s TABLE 11-continued
Structures Representing Various Modified Nucleotides, Capping Moieties, lipid PK/PD moieties and Linking Groups (wherein ⌇ indicates the point of connection)
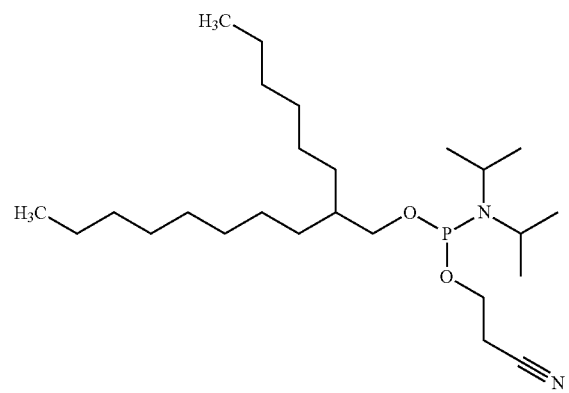
(2C6C10)-p
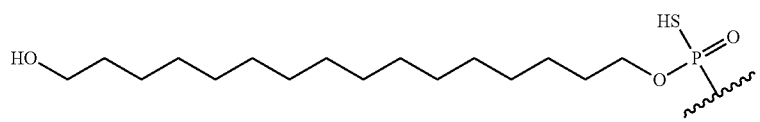
HO-C16s
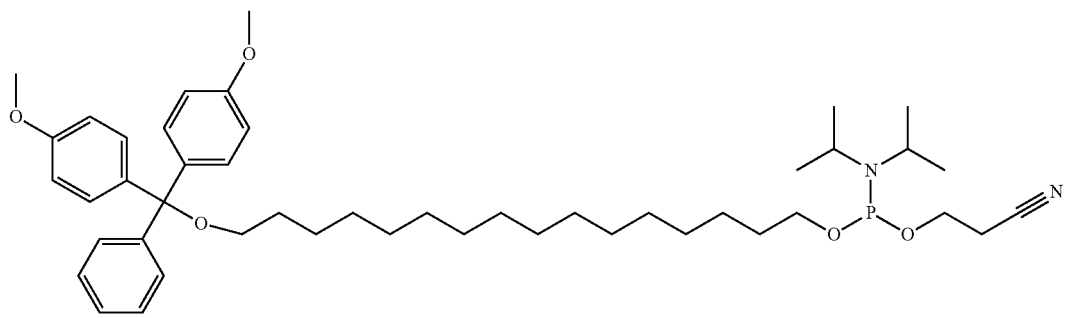
HO-C16 phosphoramidite
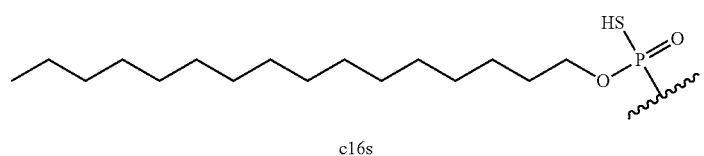
c16s
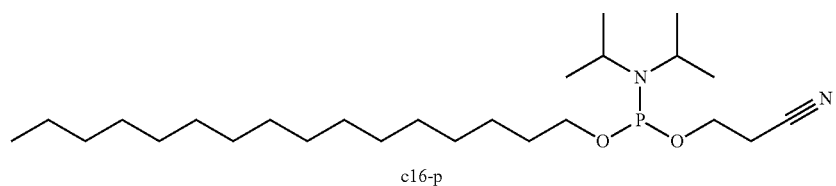
c16-p
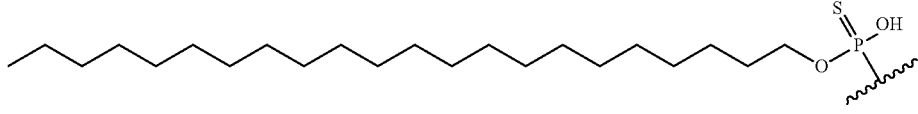
C22s TABLE 11-continued Structures Representing Various Modified Nucleotides, Capping Moieties, lipid PK/PD moieties and Linking Groups (wherein ⁑ indicates the point of connection)

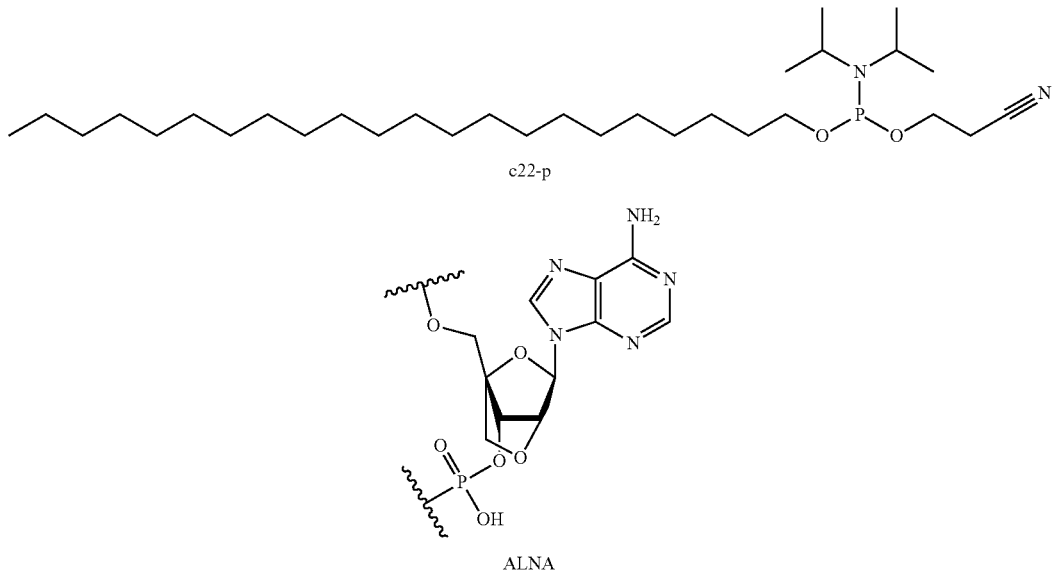

Alternatively, other linking groups known in the art may be used. In many instances, linking groups can be commercially acquired or alternatively, are incorporated into commercially available nucleotide phosphoramidites. (See, e.g., International Patent Application Publication No. WO 2019/161213, which is incorporated herein by reference in its entirety).

In some embodiments, a SOD1 RNAi agent is delivered without being conjugated to a targeting ligand or pharmacokinetic/pharmacodynamic (PK/PD) modulator (referred to as being "naked" or a "naked RNAi agent").

In some embodiments, a SOD1 RNAi agent is conjugated to a targeting group, a linking group, a PK modulator, and/or another non-nucleotide group to facilitate delivery of the SOD1 RNAi agent to the cell or tissue of choice, for example, to a CNS cell in vivo. In some embodiments, a SOD1 RNAi agent is conjugated to a lipid moiety.

In some embodiments, a delivery vehicle may be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine.

In some embodiments, the RNAi agents can be combined with lipids, nanoparticles, polymers, liposomes, micelles, DPCs or other delivery systems available in the art for nucleic acid delivery. The RNAi agents can also be chemically conjugated to targeting groups, lipids (including, but not limited to cholesteryl and cholesteryl derivatives), encapsulating in nanoparticles, liposomes, micelles, conjugating to polymers or DPCs (see, for example WO 2000/053722, WO 2008/022309, WO 2011/104169, and WO 2012/083185, WO 2013/032829, WO 2013/158141, each of which is incorporated herein by reference), by iontophoresis, or by incorporation into other delivery vehicles or systems available in the art such as hydrogels, cyclodextrins, biodegradable nanocapsules, bioadhesive microspheres, or proteinaceous vectors. In some embodiments the RNAi agents can be conjugated to antibodies having affinity for CNS cells. In some embodiments, the RNAi agents can be linked to targeting ligands that have affinity for CNS cells or receptors present on CNS cells.

Pharmaceutical Compositions and Formulations

The SOD1 RNAi agents disclosed herein can be prepared as pharmaceutical compositions or formulations (also referred to herein as "medicaments"). In some embodiments, pharmaceutical compositions include at least one SOD1 RNAi agent. These pharmaceutical compositions are particularly useful in the inhibition of the expression of SOD1 mRNA in a target cell, a group of cells, a tissue, or an organism. The pharmaceutical compositions can be used to treat a subject having a disease, disorder, or condition that would benefit from reduction in the level of the target mRNA, or inhibition in expression of the target gene. The pharmaceutical compositions can be used to treat a subject at risk of developing a disease or disorder that would benefit from reduction of the level of the target mRNA or an inhibition in expression the target gene. In one embodiment, the method includes administering a SOD1 RNAi agent linked to a PK/PD modulator as described herein, to a subject to be treated. In some embodiments, one or more pharmaceutically acceptable excipients (including vehicles, carriers, diluents, and/or delivery polymers) are added to the pharmaceutical compositions that include a SOD1 RNAi agent, thereby forming a pharmaceutical formulation or medicament suitable for in vivo delivery to a subject, including a human.

The pharmaceutical compositions that include a SOD1 RNAi agent and methods disclosed herein decrease the level of the target mRNA in a cell, group of cells, group of cells, tissue, organ, or subject, including by administering to the subject a therapeutically effective amount of a herein described SOD1 RNAi agent, thereby inhibiting the expression of SOD1 mRNA in the subject. In some embodiments, the subject has been previously identified or diagnosed as having a disease or disorder that can be mediated at least in part by a reduction in SOD1 gene expression. In some embodiments, the subject has been previously diagnosed with having one or more neurodegenerative diseases such as ALS and Alzheimer's Disease. In some embodiments the neurodegenerative disease is ALS.

In some embodiments the subject has been previously diagnosed with having neurodegenerative disease.

Embodiments of the present disclosure include pharmaceutical compositions for delivering a SOD1 RNAi agent to a CNS cell in vivo. Such pharmaceutical compositions can include, for example, a SOD1 RNAi agent conjugated to a lipid moiety.

In some embodiments, the described pharmaceutical compositions including a SOD1 RNAi agent are used for treating or managing clinical presentations in a subject that would benefit from the inhibition of expression of SOD1. In some embodiments, a therapeutically or prophylactically effective amount of one or more of pharmaceutical compositions is administered to a subject in need of such treatment. In some embodiments, administration of any of the disclosed SOD1 RNAi agents can be used to decrease the number, severity, and/or frequency of symptoms of a disease in a subject.

In some embodiments, the described SOD1 RNAi agents are optionally combined with one or more additional (i.e., second, third, etc.) therapeutics. A second therapeutic can be another SOD1 RNAi agent (e.g., a SOD1 RNAi agent that targets a different sequence within a SOD1 gene). In some embodiments, a second therapeutic can be an RNAi agent that targets the SOD1 gene. An additional therapeutic can also be a small molecule drug, antibody, antibody fragment, and/or aptamer. The SOD1 RNAi agents, with or without the one or more additional therapeutics, can be combined with one or more excipients to form pharmaceutical compositions.

The described pharmaceutical compositions that include a SOD1 RNAi agent can be used to treat at least one symptom in a subject having a disease or disorder that would benefit from reduction or inhibition in expression of SOD1 mRNA. In some embodiments, the subject is administered a therapeutically effective amount of one or more pharmaceutical compositions that include a SOD1 RNAi agent thereby treating the symptom. In other embodiments, the subject is administered a prophylactically effective amount of one or more SOD1 RNAi agents, thereby preventing or inhibiting the at least one symptom.

In some embodiments, one or more of the described SOD1 RNAi agents are administered to a mammal in a pharmaceutically acceptable carrier or diluent. In some embodiments, the mammal is a human.

The route of administration is the path by which a SOD1 RNAi agent is brought into contact with the body. In general, methods of administering drugs, oligonucleotides, and nucleic acids including the CNS, for treatment of a mammal are well known in the art and can be applied to administration of the compositions described herein. The SOD1 RNAi agents disclosed herein can be administered via any suitable route in a preparation appropriately tailored to the particular route. Thus, in some embodiments, the herein described pharmaceutical compositions are administered via inhalation, intranasal administration, intratracheal administration, or oropharyngeal aspiration administration. In some embodiments, the pharmaceutical compositions can be administered by injection, for example, intravenously, intramuscularly, intracutaneously, subcutaneously, intracerebroventricularly, intraarticularly, intraocularly, or intraperitoneally, or topically.

The pharmaceutical compositions including a SOD1 RNAi agent described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with the compositions described herein. For example, delivery can be by local administration, (e.g., direct injection, implantation, or topical administering), systemic administration, or subcutaneous, intravenous, intraperitoneal, or parenteral routes, including intracranial (e.g., intraventricular, intraparenchymal and intrathecal), intracerebroventricular, intramuscular, transdermal, airway (aerosol), nasal, oral, rectal, or topical (including buccal and sublingual) administration. In some embodiments, the compositions are administered via inhalation, intranasal administration, oropharyngeal aspiration administration, or intratracheal administration. For example, in some embodiments, it is desired that the SOD1 RNAi agents described herein inhibit the expression of an SOD1 gene in the CNS.

In some embodiments, the pharmaceutical compositions described herein comprise one or more pharmaceutically acceptable excipients. The pharmaceutical compositions described herein are formulated for administration to a subject.

As used herein, a pharmaceutical composition or medicament includes a pharmacologically effective amount of at least one of the described therapeutic compounds and one or more pharmaceutically acceptable excipients. Pharmaceutically acceptable excipients (excipients) are substances other than the Active Pharmaceutical Ingredient (API, therapeutic product, e.g., SOD1 RNAi agent) that are intentionally included in the drug delivery system. Excipients do not exert or are not intended to exert a therapeutic effect at the intended dosage. Excipients can act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, detergents, dextran, dextrose, diluents, disintegrants, emulsifiers, extenders, fillers, flavors, glidants, humectants, lubricants, oils, polymers, preservatives, saline, salts, solvents, sugars, surfactants, suspending agents, sustained release matrices, sweeteners, thickening agents, tonicity agents, vehicles, water-repelling agents, and wetting agents.

Pharmaceutical compositions suitable for injectable use include sterile aqueous solutions (where water-soluble) or dispersions and sterile powders for the extemporaneous preparation of sterile injectable solutions or dispersion. For intravenous administration, suitable carriers include physiological saline, bacteriostatic water, Cremophor® ELTM (BASF, Parsippany, NJ) or phosphate buffered saline (PBS). It should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle which contains a basic dispersion medium and the required other ingredients from those enumerated above. In the case of sterile powders for the preparation of sterile injectable solutions, methods of preparation include vacuum drying and freeze-drying which yields a powder of the active ingredient plus any additional desired ingredient from a previously sterile-filtered solution thereof.

Formulations suitable for intra-articular administration can be in the form of a sterile aqueous preparation of the drug that can be in microcrystalline form, for example, in the form of an aqueous microcrystalline suspension. Liposomal formulations or biodegradable polymer systems can also be used to present the drug for both intra-articular and ophthalmic administration.

The active compounds can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art, for example, as described in U.S. Pat. No. 4,522,811.

The SOD1 RNAi agents can be formulated in compositions in dosage unit form for ease of administration and uniformity of dosage. Dosage unit form refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the therapeutic effect to be achieved, and the limitations inherent in the art of compounding such an active compound for the treatment of individuals.

A pharmaceutical composition can contain other additional components commonly found in pharmaceutical compositions. Such additional components include, but are not limited to: anti-pruritics, astringents, local anesthetics, or anti-inflammatory agents (e.g., antihistamine, diphenhydramine, etc.). It is also envisioned that cells, tissues, or isolated organs that express or comprise the herein defined RNAi agents may be used as "pharmaceutical compositions." As used herein, "pharmacologically effective amount," "therapeutically effective amount," or simply "effective amount" refers to that amount of an RNAi agent to produce a pharmacological, therapeutic, or preventive result.

In some embodiments, SOD1 RNAi agent pharmaceutical compositions may contain salts such as sodium chloride, calcium chloride, magnesium chloride, potassium chloride, sodium phosphate dibasic, sodium phosphate monobasic, or combinations thereof.

In some embodiments, the methods disclosed herein further comprise the step of administering a second therapeutic or treatment in addition to administering an RNAi agent disclosed herein. In some embodiments, the second therapeutic is another SOD1 RNAi agent (e.g., a SOD1 RNAi agent that targets a different sequence within the SOD1 target). In other embodiments, the second therapeutic can be a small molecule drug, an antibody, an antibody fragment, and/or an aptamer.

In some embodiments, described herein are compositions that include a combination or cocktail of at least two SOD1 RNAi agents having different sequences. In some embodiments, the two or more SOD1 RNAi agents are each separately and independently linked to lipids.

Described herein are compositions for delivery of SOD1 RNAi agents to central nervous system (CNS) cells. Furthermore, compositions for delivery of SOD1 RNAi agents to cells, including neurons, astrocytes, microglia and endothelial cells, in vivo, are generally described herein.

Generally, an effective amount of a SOD1 RNAi agent disclosed herein will be in the range of from about 0.0001 to about 20 mg/kg of body weight dose, e.g., from about 0.001 to about 5 mg/kg of body weight dose. In some embodiments, an effective amount of a SOD1 RNAi agent will be in the range of from about 0.01 mg/kg to about 3.0 mg/kg of body weight per dose. In some embodiments, an effective amount of a SOD1 RNAi agent will be in the range of from about 0.03 mg/kg to about 2.0 mg/kg of body weight per dose. In some embodiments, an effective amount of a SOD1 RNAi agent will be in the range of from about 0.01 to about 1.0 mg/kg. In some embodiments, an effective amount of a SOD1 RNAi agent will be in the range of from about 0.50 to about 1.0 mg/kg. In some embodiments, a fixed dose of SOD1 RNAi agent is administered to the subject. In some embodiments the dose administered to the human subject is between about 1.0 mg and about 750 mg. In some embodiments, the dose of SOD1 RNAi agent administered to the human subject is between about 10 mg and about 450 mg. In some embodiments, the dose of SOD1 RNAi agent administered to the human subject is between about 25 mg and about 450 mg. In some embodiments, the dose of SOD1 RNAi agent administered to the human subject is about 50 mg, about 75 mg, about 100 mg, about 150 mg, about 200 mg, about 250 mg, about 300 mg, about 350 mg, about 400 mg, or about 450 mg. The amount administered will also likely depend on such variables as the overall health status of the patient, the relative biological efficacy of the compound delivered, the formulation of the drug, the presence and types of excipients in the formulation, and the route of administration. Also, it is to be understood that the initial dosage administered can be increased beyond the above upper level to rapidly achieve the desired blood-level or tissue level, or the initial dosage can be smaller than the optimum. In some embodiments, a dose is administered daily. In some embodiments, a dose is administered weekly. In further embodiments, a dose is administered bi-weekly, tri-weekly, once monthly, or once quarterly (i.e., once every three months).

For treatment of disease or for formation of a medicament or composition for treatment of a disease, the pharmaceutical compositions described herein including a SOD1 RNAi agent can be combined with an excipient or with a second therapeutic agent or treatment including, but not limited to: a second or other RNAi agent, a small molecule drug, an antibody, an antibody fragment, peptide, and/or an aptamer.

The described SOD1 RNAi agents, when added to pharmaceutically acceptable excipients or adjuvants, can be packaged into kits, containers, packs, or dispensers.

Methods of Treatment and Inhibition of SOD1 Gene Expression

The SOD1 RNAi agents disclosed herein can be used to treat a subject (e.g., a human or other mammal) having a disease or disorder that would benefit from administration of the RNAi agent. In some embodiments, the RNAi agents disclosed herein can be used to treat a subject (e.g., a human) that would benefit from a reduction and/or inhibition in expression of SOD1 mRNA and/or a reduction in SOD1 protein and/or enzyme levels.

In some embodiments, the RNAi agents disclosed herein can be used to treat a subject (e.g., a human) having a disease or disorder for which the subject would benefit from reduction in mutant SOD1 enzyme, including but not limited to, ALS and Alzheimer's Disease. Treatment of a subject can include therapeutic and/or prophylactic treatment. The subject is administered a therapeutically effective amount of any one or more SOD1 RNAi agents described herein. The subject can be a human, patient, or human patient. The subject may be an adult, adolescent, child, or infant. Administration of a pharmaceutical composition described herein can be to a human being or animal.

Mutant SOD1 activity is known to promote neurodegenerative disorders. In some embodiments, the described SOD1 RNAi agents are used to treat at least one symptom mediated at least in part by a reduction in mutant SOD1 enzyme levels, in a subject. The subject is administered a therapeutically effective amount of any one or more of the described SOD1 RNAi agents. In some embodiments, the subject is administered a prophylactically effective amount of any one or more of the described RNAi agents, thereby treating the subject by preventing or inhibiting the at least one symptom.

In certain embodiments, the present disclosure provides methods for treatment of diseases, disorders, conditions, or pathological states mediated at least in part by SOD1 gene expression, in a patient in need thereof, wherein the methods include administering to the patient any of the SOD1 RNAi agents described herein.

In some embodiments, the SOD1 RNAi agents are used to treat or manage a clinical presentation or pathological state in a subject, wherein the clinical presentation or pathological state is mediated at least in part by a reduction in SOD1 gene expression. The subject is administered a therapeutically effective amount of one or more of the SOD1 RNAi agents or SOD1 RNAi agent-containing compositions described herein. In some embodiments, the method comprises administering a composition comprising a SOD1 RNAi agent described herein to a subject to be treated.

In a further aspect, the disclosure features methods of treatment (including prophylactic or preventative treatment) of diseases or symptoms that may be addressed by a reduction in SOD1 protein and/or enzyme levels, the methods comprising administering to a subject in need thereof a SOD1 RNAi agent that includes an antisense strand comprising the sequence of any of the sequences in Table 2, Table 3, or Table 10. Also described herein are compositions for use in such methods.

The described SOD1 RNAi agents and/or compositions that include SOD1 RNAi agents can be used in methods for therapeutic treatment of disease or conditions caused by enhanced or elevated SOD1 protein and/or enzyme activity levels. Such methods include administration of a SOD1 RNAi agent as described herein to a subject, e.g., a human or animal subject.

In another aspect, the disclosure provides methods for the treatment (including prophylactic treatment) of a pathological state (such as a condition or disease) mediated at least in part by SOD1 gene expression, wherein the methods include administering to a subject a therapeutically effective amount of an RNAi agent that includes an antisense strand comprising the sequence of any of the sequences in Table 2, Table 3, or Table 10.

In some embodiments, methods for inhibiting expression of an SOD1 gene are disclosed herein, wherein the methods include administering to a cell an RNAi agent that includes an antisense strand comprising the sequence of any of the sequences in Table 2, Table 3, or Table 10.

In some embodiments, methods for the treatment (including prophylactic treatment) of a pathological state mediated at least in part by SOD1 gene expression are disclosed herein, wherein the methods include administering to a subject a therapeutically effective amount of an RNAi agent that includes a sense strand comprising the sequence of any of the sequences in Table 2, Table 4, Table 5, Table 6, Table 6a, or Table 10.

In some embodiments, methods for inhibiting expression of an SOD1 gene are disclosed herein, wherein the methods comprise administering to a cell an RNAi agent that includes a sense strand comprising the sequence of any of the sequences in Table 2, Table 4. Table 5, Table 6, Table 6a, or Table 10.

In some embodiments, methods for the treatment (including prophylactic treatment) of a pathological state mediated at least in part by SOD1 gene expression are disclosed herein, wherein the methods include administering to a subject a therapeutically effective amount of an RNAi agent that includes a sense strand comprising the sequence of any of the sequences in Table 4, Table 5, Table 6, Table 6a, or Table 10, and an antisense strand comprising the sequence of any of the sequences in Table 3 or Table 10.

In some embodiments, methods for inhibiting expression of a SOD1 gene are disclosed herein, wherein the methods include administering to a cell an RNAi agent that includes a sense strand comprising the sequence of any of the sequences in Table 4, Table 5, Table 6, Table 6a, or Table 10, and an antisense strand comprising the sequence of any of the sequences in Table 3 or Table 10.

In some embodiments, methods of inhibiting expression of a SOD1 gene are disclosed herein, wherein the methods include administering to a subject a SOD1 RNAi agent that includes a sense strand consisting of the nucleobase sequence of any of the sequences in Table 4, Table 5, Table 6, Table 6a, or Table 10, and the antisense strand consisting of the nucleobase sequence of any of the sequences in Table 3 or Table 10. In other embodiments, disclosed herein are methods of inhibiting expression of a SOD1 gene, wherein the methods include administering to a subject a SOD1 RNAi agent that includes a sense strand consisting of the modified sequence of any of the modified sequences in Table 4, Table 5, Table 6, Table 6a, or Table 10, and the antisense strand consisting of the modified sequence of any of the modified sequences in Table 3 or Table 10.

In some embodiments, methods for inhibiting expression of an SOD1 gene in a cell are disclosed herein, wherein the methods include administering one or more SOD1 RNAi agents comprising a duplex structure of one of the duplexes set forth in Tables 7A, 7B, 8, 9A, and 10.

In some embodiments, the gene expression level and/or mRNA level of an SOD1 gene in certain CNS cells of subject to whom a described SOD1 RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99%, relative to the subject prior to being administered the SOD1 RNAi agent or to a subject not receiving the SOD1 RNAi agent. In some embodiments, the SOD1 protein and/or enzyme levels in certain CNS cells of a subject to whom a described SOD1 RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99%, relative to the subject prior to being administered the SOD1 RNAi agent or to a subject not receiving the SOD1 RNAi agent. The gene expression level, protein level, and/or mRNA level in the subject may be reduced in a cell, group of cells, and/or tissue of the subject. In some embodiments, the SOD1 mRNA levels in certain CNS cells subject to whom a described SOD1 RNAi agent has been administered is reduced by at least about 30%, 35%, 40%, 45%, 50%, 55%, 60%, 65%, 70%, 75%, 80%, 85%, 90%, 95%, or 98% relative to the subject prior to being administered the SOD1 RNAi agent or to a subject not receiving the SOD1 RNAi agent.

A reduction in gene expression, mRNA, and protein levels can be assessed by any methods known in the art. Reduction or decrease in SOD1 protein and or enzyme levels are collectively referred to herein as a decrease in, reduction of, or inhibition of SOD1 expression. The Examples set forth herein illustrate known methods for assessing inhibition of SOD1 gene expression, including but not limited to determining SOD1 enzyme levels.

Cells, Tissues, Organs, and Non-Human Organisms

Cells, tissues, organs, and non-human organisms that include at least one of the SOD1 RNAi agents described herein are contemplated. The cell, tissue, organ, or non-human organism is made by delivering the RNAi agent to the cell, tissue, organ, or non-human organism.

Additional Illustrative Embodiments

Provided here are certain additional illustrative embodiments of the disclosed technology. These embodiments are illustrative only and do not limit the scope of the present disclosure or of the claims attached hereto.

Embodiment 1. An RNAi agent for inhibiting expression of a Superoxide Dismutase 1 (SOD1) gene, comprising:
an antisense strand comprising at least 17 contiguous nucleotides differing by 0 or 1 nucleotides from any one of the sequences provided in Table 2 or Table 3; and
a sense strand comprising a nucleotide sequence that is at least partially complementary to the antisense strand.

Embodiment 2. The RNAi agent of embodiment 1, wherein the antisense strand comprises nucleotides 2-18 of any one of the sequences provided in Table 2 or Table 3.

Embodiment 3. The RNAi agent of embodiment 1 or embodiment 2, wherein the sense strand comprises a nucleotide sequence of at least 17 contiguous nucleotides differing by 0 or 1 nucleotides from any one of the sequences provided in Table 2 or Table 4, and wherein the sense strand has a region of at least 85% complementarity over the 17 contiguous nucleotides to the antisense strand.

Embodiment 4. The RNAi agent of any one of embodiments 1-3, wherein at least one nucleotide of the SOD1 RNAi agent is a modified nucleotide or includes a modified internucleoside linkage.

Embodiment 5. The RNAi agent of any one of embodiments 1-4, wherein all or substantially all of the nucleotides are modified nucleotides.

Embodiment 6. The RNAi agent of any one of embodiments 4-5, wherein the modified nucleotide is selected from the group consisting of: 2'-O-methyl nucleotide, 2'-fluoro nucleotide, 2'-deoxy nucleotide, 2',3'-seco nucleotide mimic, locked nucleotide, 2'-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholino nucleotide, vinyl phosphonate-containing nucleotide, cyclopropyl phosphonate-containing nucleotide, and 3'-O-methyl nucleotide.

Embodiment 7. The RNAi agent of embodiment 5, wherein all or substantially all of the nucleotides are modified with 2'-O-methyl nucleotides, 2'-fluoro nucleotides, or combinations thereof.

Embodiment 8. The RNAi agent of any one of embodiments 1-7, wherein the antisense strand comprises the nucleotide sequence of any one of the modified sequences provided in Table 3.

Embodiment 9. The RNAi agent of any one of embodiments 1-8, wherein the sense strand comprises the nucleotide sequence of any one of the modified sequences provided in Table 4.

Embodiment 10. The RNAi agent of embodiment 1, wherein the antisense strand comprises the nucleotide sequence of any one of the modified sequences provided in Table 3 and the sense strand comprises the nucleotide sequence of any one of the modified sequences provided in Table 4.

Embodiment 11. The RNAi agent of any one of embodiments 1-10, wherein the sense strand is between 18 and 30 nucleotides in length, and the antisense strand is between 18 and 30 nucleotides in length.

Embodiment 12. The RNAi agent of embodiment 11, wherein the sense strand and the antisense strand are each between 18 and 27 nucleotides in length.

Embodiment 13. The RNAi agent of embodiment 12, wherein the sense strand and the antisense strand are each between 18 and 24 nucleotides in length.

Embodiment 14. The RNAi agent of embodiment 13, wherein the sense strand and the antisense strand are each 21 nucleotides in length.

Embodiment 15. The RNAi agent of embodiment 14, wherein the RNAi agent has two blunt ends.

Embodiment 16. The RNAi agent of any one of embodiments 1-15, wherein the sense strand comprises one or two terminal caps.

Embodiment 17. The RNAi agent of any one of embodiments 1-16, wherein the sense strand comprises one or two inverted abasic residues.

Embodiment 18. The RNAi agent of embodiment 1, wherein the RNAi agent is comprised of a sense strand and an antisense strand that form a duplex having the structure of any one of the duplexes in Table 7A, Table 7B, Table 8, Table 9A, or Table 10.

Embodiment 19. The RNAi agent of embodiment 18, wherein all or substantially all of the nucleotides are modified nucleotides.

Embodiment 20. The RNAi agent of embodiment 1, comprising an antisense strand that consists of, consists essentially of, or comprises a nucleotide sequence that differs by 0 or 1 nucleotides from one of the following nucleotide sequences (5'→3'):

```
                                    (SEQ ID NO: 54)
UGAUAGAGGAUUAAAGUGA;

(SEQ ID NO: 59)
UAGGAUAACAGAUGAGUUA;

(SEQ ID NO: 64)
UGAGAUCACAGAAUCUUCA;

(SEQ ID NO: 1084)
UGAUAGAGGAUUAAAGUGAGG;

(SEQ ID NO: 1090)
UAGGAUAACAGAUGAGUUAAG;
or (SEQ ID NO: 1105)
UGAGAUCACAGAAUCUUCAAC.
```

Embodiment 21. The RNAi agent of embodiment 20, wherein the sense strand consists of, consists essentially of, or comprises a nucleotide sequence that differs by 0 or 1 nucleotides from one of the following nucleotide sequences (5'→3'):

```
                                    (SEQ ID NO: 288)
UCACUUUAAUCCUCUAUCA;

(SEQ ID NO: 293)
UAACUCAUCUGUUAUCCUA;

(SEQ ID NO: 298)
GUUGAAGAUUCUGUGAUCU;

(SEQ ID NO: 1151)
CCUCACUUUAAUCCUCUAUCA;

(SEQ ID NO: 1157)
CUUAACUCAUCUGUUAUCCUA;
or (SEQ ID NO: 1172)
GUUGAAGAUUCUGUGAUCUCA.
```

Embodiment 22. The RNAi agent of embodiment 20 or 21, wherein all or substantially all of the nucleotides are modified nucleotides.

Embodiment 23. The RNAi agent of embodiment 1, comprising an antisense strand that comprises, consists of, or consists essentially of a modified nucleotide sequence that differs by 0 or 1 nucleotides from one of the following nucleotide sequences (5'→3'):

```
                                    (SEQ ID NO: 578)
cPrpusGfsasuagAfggAfuUfaAfaGfugagsg;

(SEQ ID NO: 613)
cPrpusGfsasuagAUNAggAfuUfaAfaGfugagsg;

(SEQ ID NO: 589)
cPrpuAfgGfauaacagAfuGfaGfuuaassg;
or (SEQ ID NO: 646)
cPrpusGfsaGfaucacagAfaUfcUfucasasc;
``` wherein a, c, g, and u represent 2'-O-methyl adenosine, 2'-O-methyl cytidine, 2'-O-methyl guanosine, and 2'-O-methyl uridine, respectively; Af, Cf, Gf, and Uf represent 2'-fluoro adenosine, 2'-fluoro cytidine, 2'-fluoro guanosine, and 2'-fluoro uridine, respectively; cPrpu represents a 5'-cyclopropyl phosphonate-2'-O-methyl uridine; s represents a phosphorothioate linkage; $A_{UNA}$ represents 2',3'-seco-adenosine-3'-phosphate; and wherein all or substantially all of the nucleotides on the sense strand are modified nucleotides.

Embodiment 24. The RNAi agent of embodiment 1, wherein the sense strand comprises, consists of, or consists essentially of a modified nucleotide sequence that differs by 0 or 1 nucleotides from one of the following nucleotide sequences (5'→3'):

```
                                    (SEQ ID NO: 685)
ccucacuuUfAfAfuccucuauca;

(SEQ ID NO: 691)
cuuaacucAfUfCfuguuauccua;
or (SEQ ID NO: 771)
guugaagaUfuCfuGfugaucuca;
``` wherein a, c, g, i, and u represent 2'-O-methyl adenosine, 2'-O-methyl cytidine, 2'-O-methyl guanosine, 2'-O-methyl inosine, and 2'-O-methyl uridine, respectively; Af, Cf, Gf, and Uf represent 2'-fluoro adenosine, 2'-fluoro cytidine, 2'-fluoro guanosine, and 2'-fluoro uridine, respectively; and s represents a phosphorothioate linkage; and wherein all or substantially all of the nucleotides on the antisense strand are modified nucleotides.

Embodiment 25. The RNAi agent of any one of embodiments 20-24, wherein the sense strand further includes inverted abasic residues at the 3' terminal end of the nucleotide sequence, at the 5' end of the nucleotide sequence, or at both.

Embodiment 26. The RNAi agent of any one of embodiments 1-25, wherein the RNAi agent is linked to a lipid moiety.

Embodiment 27. The RNAi agent of embodiment 26, wherein the lipid moiety is selected from the group consisting of:

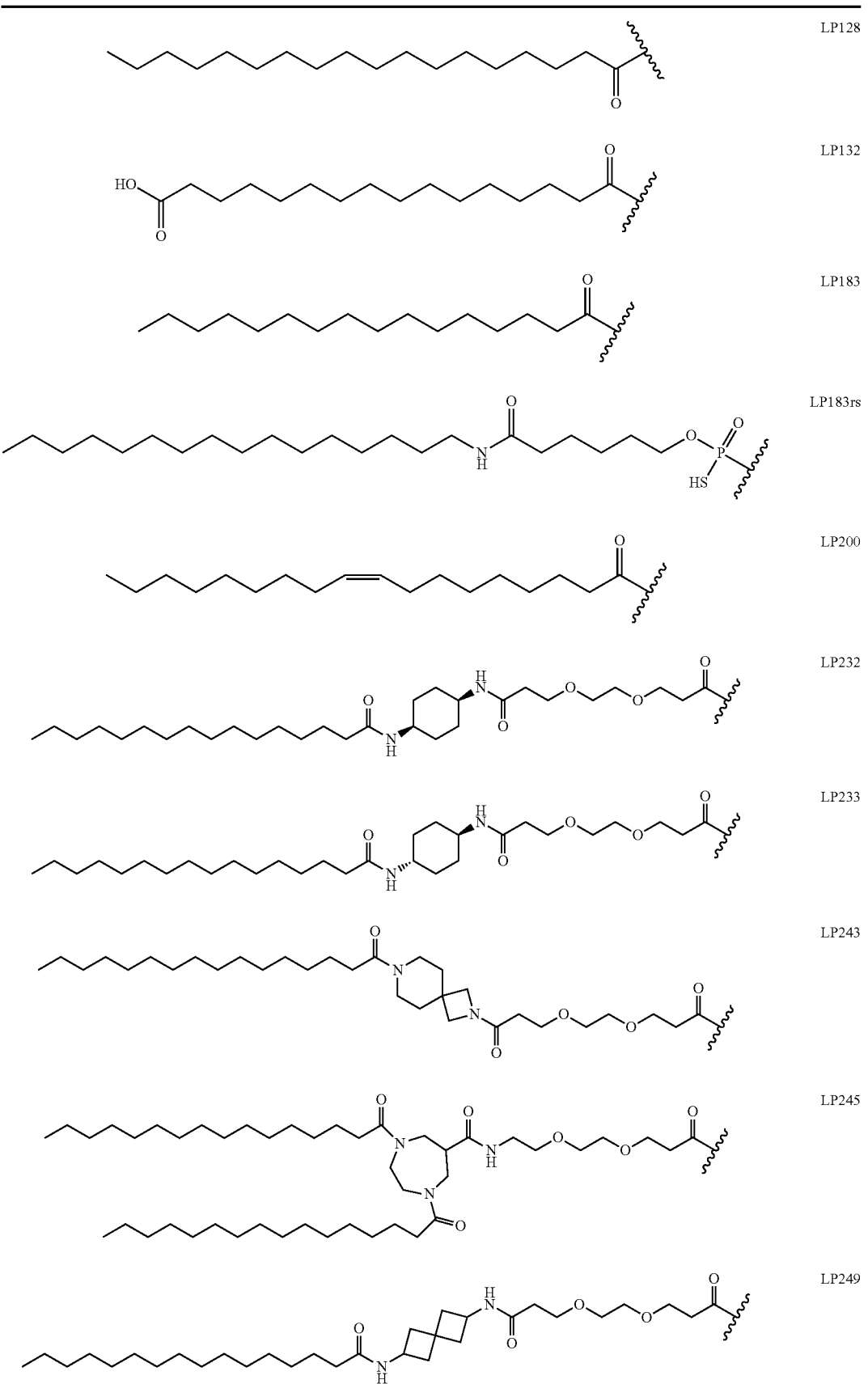

-continued
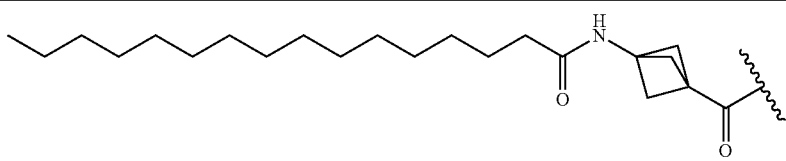 LP257
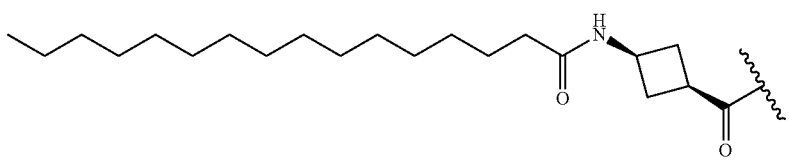 [SMILES: *C(=O)[C@H]1C[C@@H](NC(=O)CCCCCCCCCCCCCCC)C1] LP259
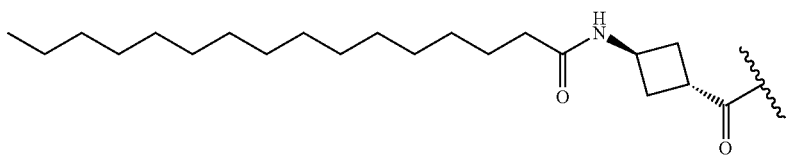 [SMILES: *C(=O)[C@H]1C[C@H](NC(=O)CCCCCCCCCCCCCCC)C1] LP260
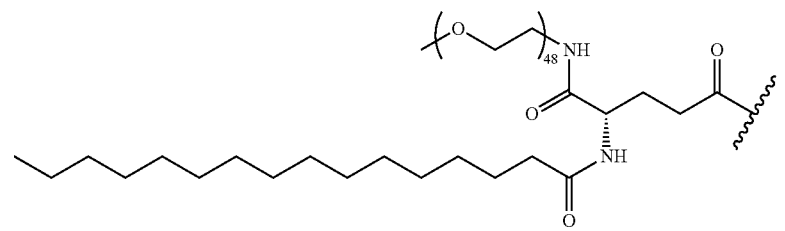 LP262
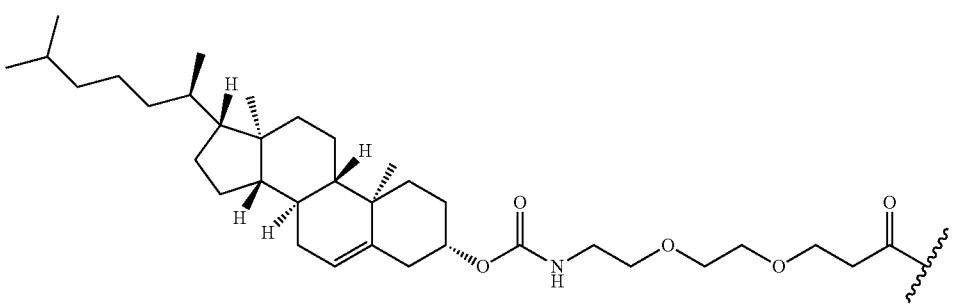 [SMILES: *C(=O)CCOCCOCCNC(=O)O[C@H]1CC[C@@]2(C)C(=CC[C@H]3[C@@H]4CC[C@H]([C@H](C)CCCC(C)C)[C@@]4(C)CC[C@@H]32)C1] LP269
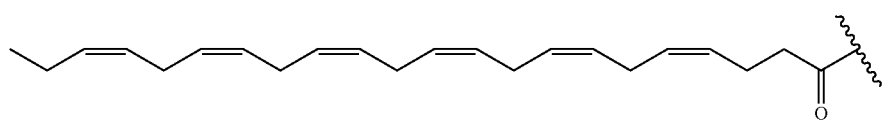 [SMILES: *C(=O)CC/C=C\C/C=C\C/C=C\C/C=C\C/C=C\C/C=C\CC] LP273
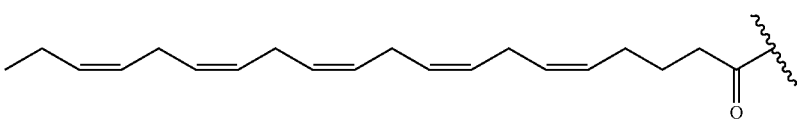 [SMILES: *C(=O)CCC/C=C\C/C=C\C/C=C\C/C=C\C/C=C\CC] LP274
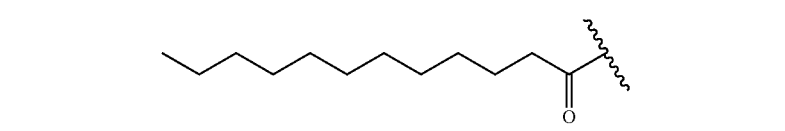 [SMILES: *C(=O)CCCCCCCCCCC] LP276
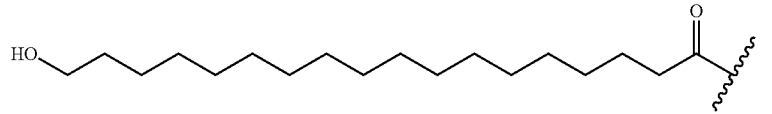 [SMILES: *C(=O)CCCCCCCCCCCCCCCCCO] LP283

-continued
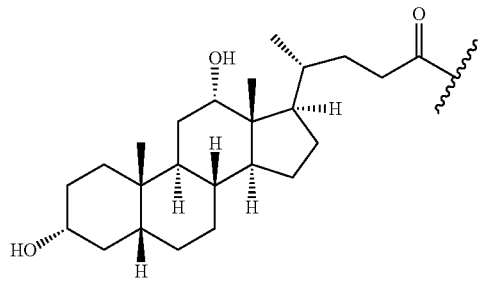
LP286
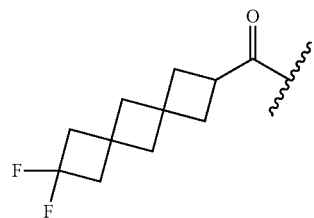 [SMILES: *C(=O)C1CC2(C1)CC1(CC(F)(F)C1)C2]
LP287
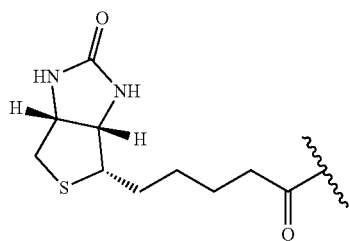 [SMILES: *C(=O)CCCC[C@@H]1SC[C@@H]2NC(=O)N[C@@H]21]
LP289
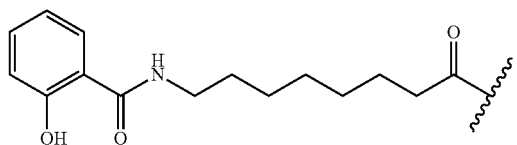 [SMILES: *C(=O)CCCCCCCNC(=O)c1ccccc1O]
LP290
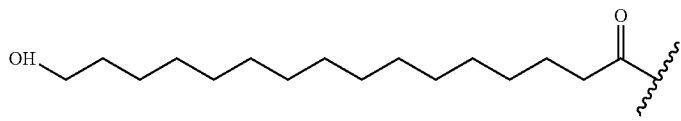 [SMILES: *C(=O)CCCCCCCCCCCCCCCO]
LP293
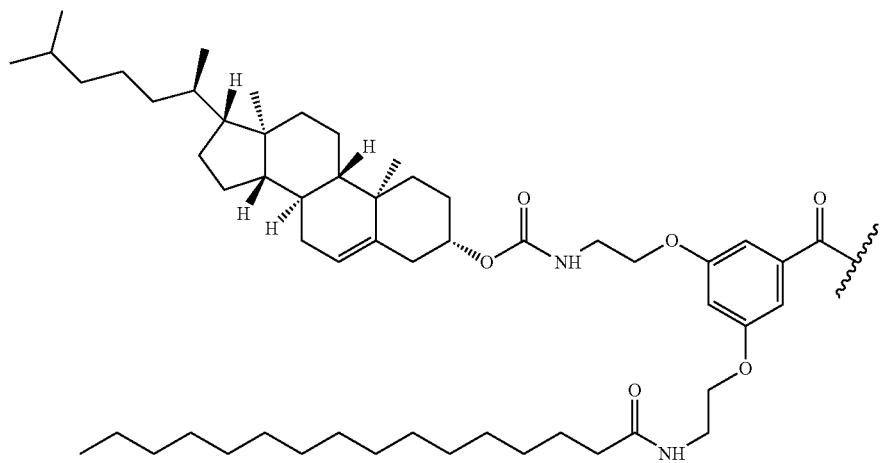 [SMILES: *C(=O)c1cc(OCCNC(=O)CCCCCCCCCCCCCCC)cc(OCCNC(=O)O[C@H]2CC[C@@]3(C)C(=CC[C@H]4[C@@H]5CC[C@H]([C@H](C)CCCC(C)C)[C@@]5(C)CC[C@@H]43)C2)c1]
LP296

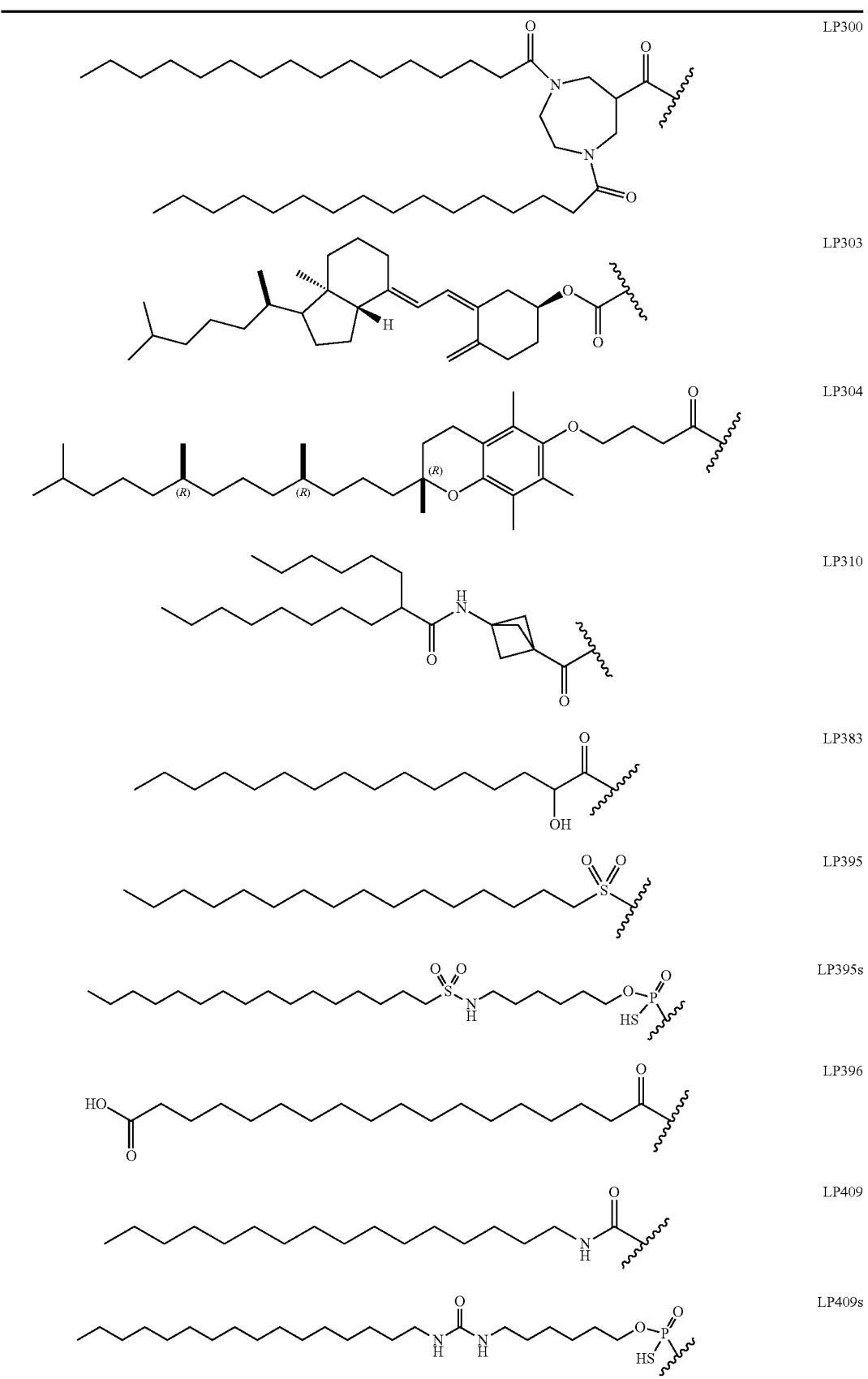

-continued
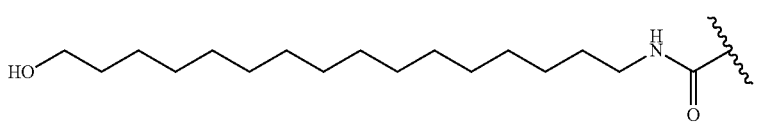 [SMILES: *C(=O)NCCCCCCCCCCCCCCCCO]  LP429
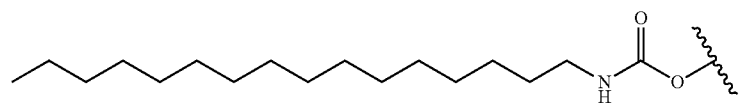 [SMILES: *OC(=O)NCCCCCCCCCCCCCCCC]  LP430
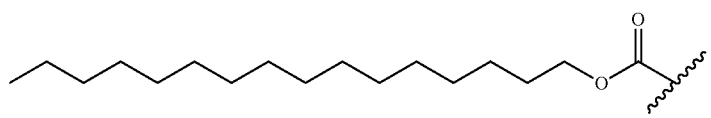 [SMILES: *C(=O)OCCCCCCCCCCCCCCCC]  LP431
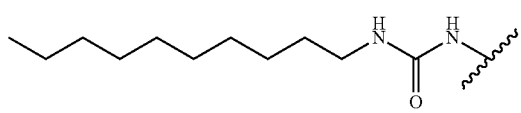 [SMILES: *NC(=O)NCCCCCCCCCC]  LP435
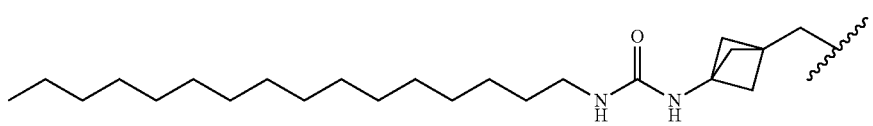 [SMILES: *CC12CC(NC(=O)NCCCCCCCCCCCCCCCC)(C1)C2]  LP439
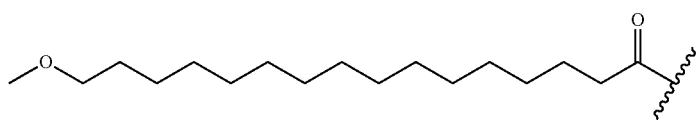 [SMILES: *C(=O)CCCCCCCCCCCCCCCOC]  LP440
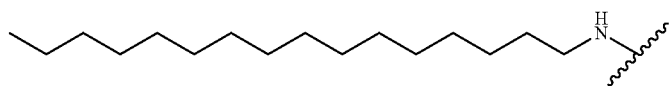 [SMILES: *NCCCCCCCCCCCCCCCC]  LP441
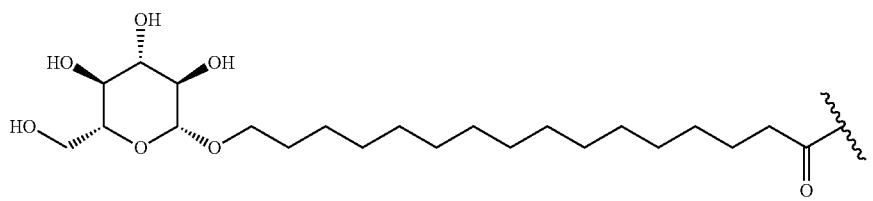 [SMILES: *C(=O)CCCCCCCCCCCCCCCO[C@@H]1O[C@H](CO)[C@@H](O)[C@H](O)[C@H]1O]  LP456
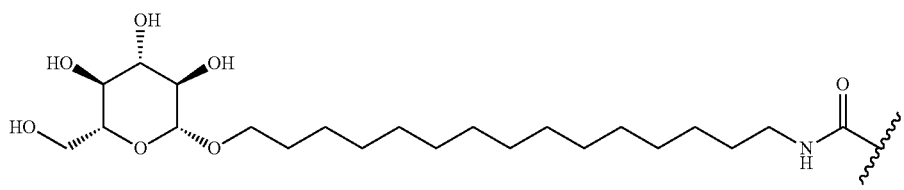 [SMILES: *C(=O)NCCCCCCCCCCCCCCCO[C@@H]1O[C@H](CO)[C@@H](O)[C@H](O)[C@H]1O]  LP462
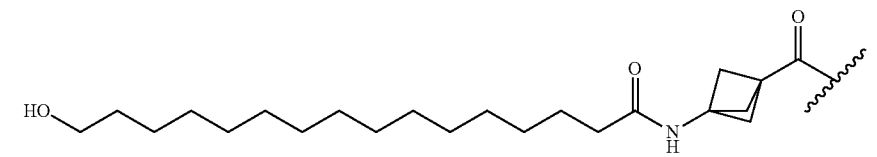 [SMILES: *C(=O)C12CC(NC(=O)CCCCCCCCCCCCCCCO)(C1)C2]  LP463
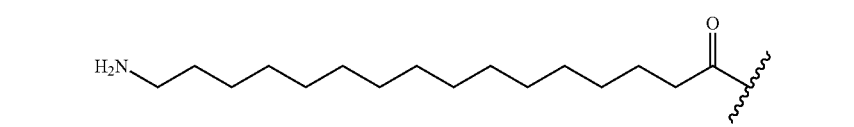 [SMILES: *C(=O)CCCCCCCCCCCCCCCN]  LP464

-continued
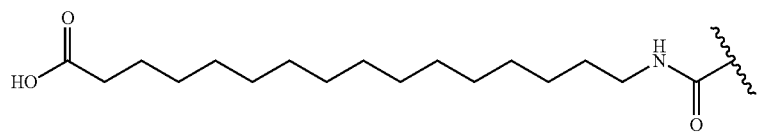 [SMILES: *C(=O)NCCCCCCCCCCCCCCCC(=O)O]
LP465
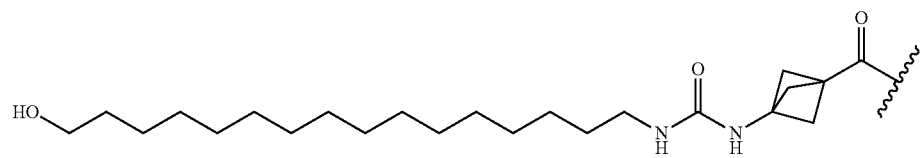 [SMILES: *C(=O)C12CC(NC(=O)NCCCCCCCCCCCCCCCCO)(C1)C2]
LP466
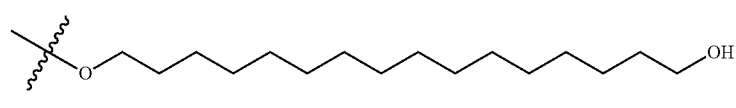
LP493a
(2' internal)
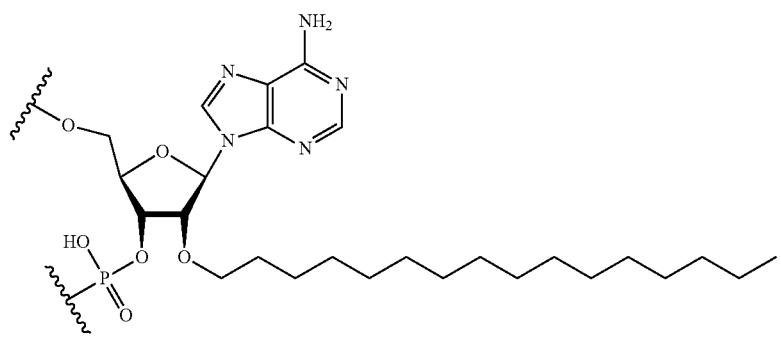
aC16
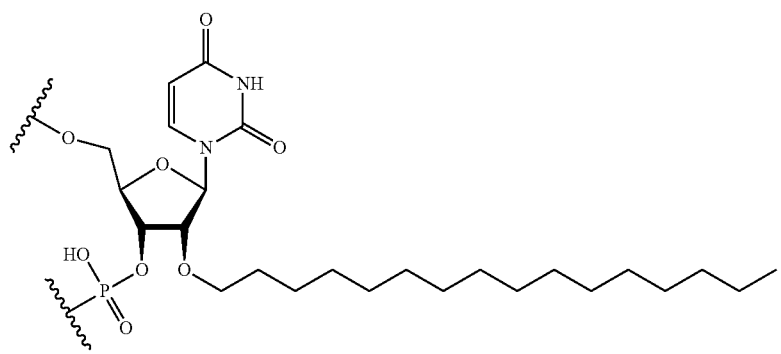
uC16
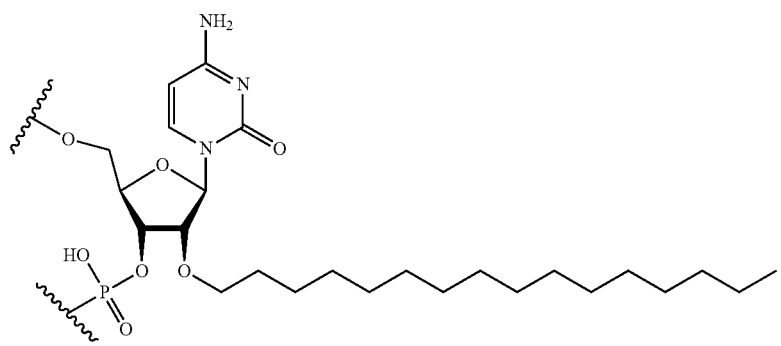
cC16

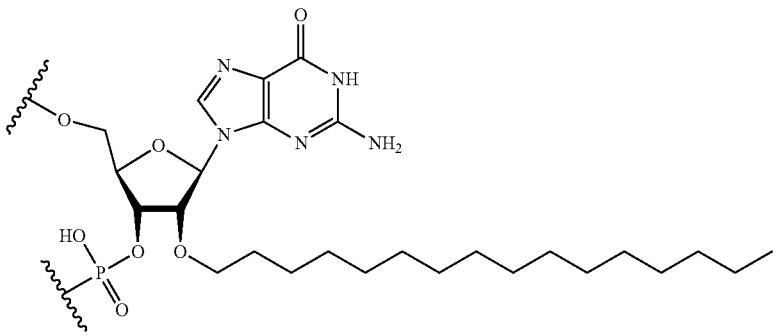
gC16

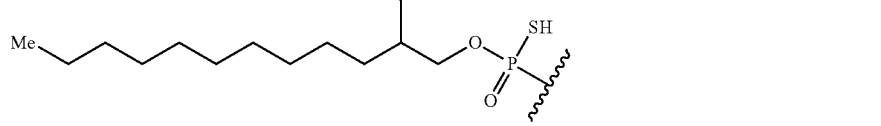
(2C8C12)s

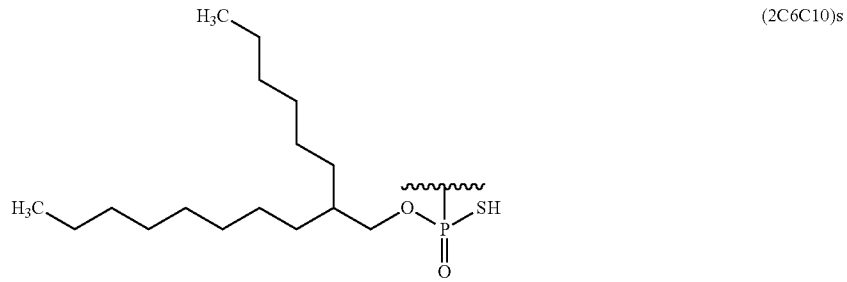
(2C6C10)s

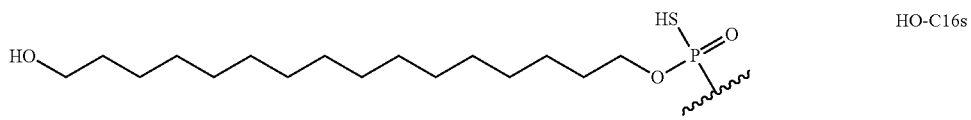
HO-C16s

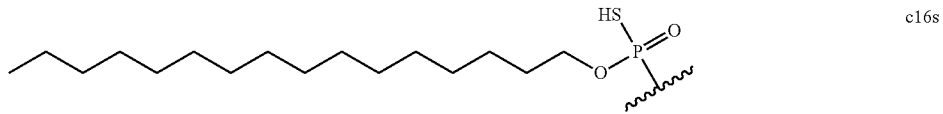
c16s

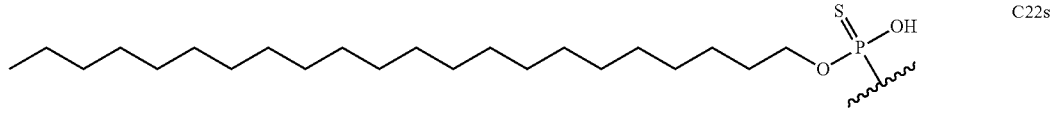
C22s wherein ⸸ indicates the point of connection to the RNAi agent.

Embodiment 28. The RNAi agent of embodiment 26 or embodiment 27, wherein the lipid moiety is conjugated to the sense strand.

Embodiment 29. The RNAi agent of embodiment 28, wherein the lipid moiety is conjugated to the 5' terminal end of the sense strand.

Embodiment 30. A composition comprising the RNAi agent of any one of embodiments 1-29, wherein the composition further comprises a pharmaceutically acceptable excipient.

Embodiment 31. The composition of embodiment 30, further comprising a second RNAi agent capable of inhibiting the expression of Superoxide Dismutase 1 gene expression.

Embodiment 32. The composition of any one of embodiments 30-31, further comprising one or more additional therapeutics.

Embodiment 33. The composition of any of embodiments 30-32, wherein the RNAi agent is a sodium salt.

Embodiment 34. The composition of any of embodiments 30-33, wherein the pharmaceutically acceptable excipient is water for injection.

Embodiment 35. The composition of any of embodiments 30-33, wherein the pharmaceutically acceptable excipient is a buffered saline solution.

Embodiment 36. The composition of any of embodiments 30-35, wherein the pharmaceutically acceptable excipient comprises sodium chloride, calcium chloride, magnesium chloride, potassium chloride, sodium phosphate dibasic, sodium phosphate monobasic, or combinations thereof.

Embodiment 37. A method for inhibiting expression of a SOD1 gene in a cell, the method comprising introducing into a cell an effective amount of an RNAi agent of any one of embodiments 1-29 or the composition of any one of embodiments 30-36.

Embodiment 38. The method of embodiment 37, wherein the cell is within a subject.

Embodiment 39. The method of embodiment 38, wherein the subject is a human subject.

Embodiment 40. The method of any one of embodiments 37-39, wherein following the administration of the RNAi agent the Superoxide Dismutase 1 (SOD1) gene expression is inhibited by at least about 30%.

Embodiment 41. A method of treating one or more symptoms or diseases associated with enhanced or elevated mutant SOD1 activity levels, the method comprising administering to a human subject in need thereof a therapeutically effective amount of the composition of any one of embodiments 30-36.

Embodiment 42. The method of embodiment 39, wherein the disease is a neurodegenerative disease.

Embodiment 43. The method of embodiment 40, wherein the neurodegenerative disease is amyotrophic lateral sclerosis (ALS) or Alzheimer's Disease.

Embodiment 44. The method of embodiment 41, wherein the disease is ALS.

Embodiment 45. The method of embodiment 42, wherein the disease is SOD1-linked familial ALS.

Embodiment 46. The method of any one of embodiments 37-45, wherein the RNAi agent is administered at a dose of about 0.01 mg/kg to about 5.0 mg/kg of body weight of the subject.

Embodiment 47. The method of any one of embodiments 37-46, wherein the RNAi agent is administered at a dose of about 0.03 mg/kg to about 2.0 mg/kg of body weight of the subject.

Embodiment 48. The method of any one of embodiments 37-45, wherein the RNAi agent is administered at a fixed dose of about 25 mg to about 450 mg.

Embodiment 49. The method embodiment 48, wherein the RNAi agent is administered at a dose of about 25 mg, about 50 mg, about 150 mg, or about 450 mg.

Embodiment 50. The method of any of embodiments 37-49, wherein the RNAi agent is administered in two or more doses.

Embodiment 51. Use of the RNAi agent of any one of embodiments 1-29, for the treatment of a disease, disorder, or symptom that is mediated at least in part by mutant SOD1 activity and/or SOD1 gene expression.

Embodiment 52. Use of the composition according to any one of embodiments 30-36, for the treatment of a disease, disorder, or symptom that is mediated at least in part by Superoxide Dismutase 1 (SOD1) activity and/or Superoxide Dismutase 1 (SOD1) gene expression.

Embodiment 53. Use of the composition according to any one of embodiments 30-36, for the manufacture of a medicament for treatment of a disease, disorder, or symptom that is mediated at least in part by Superoxide Dismutase 1 (SOD1) and/or Superoxide Dismutase 1 (SOD1) gene expression.

Embodiment 54. The use of any one of embodiments 51-53, wherein the disease is a neurodegenerative disease.

Embodiment 55. A method of making an RNAi agent of any one of embodiments 1-29, comprising annealing a sense strand and an antisense strand to form a double-stranded ribonucleic acid molecule.

Embodiment 56. The method of embodiment 55, wherein the sense strand comprises a lipid moiety.

Embodiment 57. The method of embodiment 55, comprising conjugating a lipid moiety to the sense strand.

EXAMPLES

Example 1. Synthesis of SOD1 RNAi Agents

SOD1 RNAi agent duplexes disclosed herein were synthesized in accordance with the following:

A. Synthesis. The sense and antisense strands of the SOD1 RNAi agents were synthesized according to phosphoramidite technology on solid phase used in oligonucleotide synthesis. Depending on the scale, a MerMade96E® (Bioautomation), a MerMade12® (Bioautomation), or an OP Pilot 100 (GE Healthcare) was used. Syntheses were performed on a solid support made of controlled pore glass (CPG, 500 A or 600A, obtained from Prime Synthesis, Aston, PA, USA). All RNA and 2'-modified RNA phosphoramidites were purchased from Thermo Fisher Scientific (Milwaukee, WI, USA). Specifically, the 2'-O-methyl phosphoramidites that were used included the following: (5'-O-dimethoxytrityl-$N^6$-(benzoyl)-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropyl-amino) phosphoramidite, (5'-O-dimethoxytrityl-$N^2$-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-deoxy-2'-fluoro-phosphoramidites carried the same protecting groups as the 2'-O-methyl RNA amidites. 5'-dimethoxytrityl-2'-O-methyl-inosine-3'-O-(2-cyanoethyl-N, N-diisopropylamino) phosphoramidites were purchased from Glen Research (Virginia). The inverted abasic (3'-O-dimethoxytrityl-2'-deoxyribose-5'-O-(2-cyanoethyl-N,N-diisopropylamino) phosphoramidites were purchased from ChemGenes (Wilmington, MA, USA). The following UNA phosphoramidites were used: 5'-(4,4'-Dimethoxytrityl)-N6-(benzoyl)-2',3'-seco-adenosine, 2'-benzoyl-3'-[(2-cyanoethyl)-(N,N-diisopropyl)]-phosphoramidite, 5'-(4,4'-Dimethoxytrityl)-N-acetyl-2',3'-seco-cytosine, 2'-benzoyl-3'-[(2-cyanoethyl)-(N,N-diiso-propyl)]-phosphoramidite, 5'-(4,4'-Dimethoxytrityl)-N-isobutyryl-2',3'-seco-guanosine, 2'-benzoyl-3'-[(2-cyanoethyl)-(N,N-diisopropyl)]-phosphoramidite, and 5'-(4,4'-Dimethoxy-trityl)-2',3'-seco-uridine, 2'-benzoyl-3'-[(2-cyanoethyl)-(N,N-diiso-propyl)]- phosphoramidite. TFA aminolink phosphoramidites were also commercially purchased (ThermoFisher). Linker L6 was purchased as propargyl-PEG5-NHS from BroadPharm (catalog #BP-20907) and coupled to the $NH_2$-$C_6$ group from an aminolink phosphoramidite to form -L6-C6—, using standard coupling conditions. The linker Alk-cyHex was similarly commercially purchased from Lumiprobe (alkyne phosphoramidite, 5'-terminal) as a propargyl-containing compound phosphoramidite compound to form the linker -Alk-cyHex-. In each case, phosphorothioate linkages were introduced as specified using the conditions set forth herein. The cyclopropyl phosphonate phosphoramidites were synthesized in accordance with International Patent Application Publication No. WO 2017/214112 (see also Altenhofer et. al., Chem. Communications (Royal Soc. Chem.), 57(55): 6808-6811 (July 2021)).

Tri-alkyne-containing phosphoramidites were dissolved in anhydrous dichloromethane or anhydrous acetonitrile (50 mM), while all other amidites were dissolved in anhydrous acetonitrile (50 mM) and molecular sieves (3A) were added. 5-Benzylthio-1H-tetrazole (BTT, 250 mM in acetonitrile) or 5-Ethylthio-1H-tetrazole (ETT, 250 mM in acetonitrile) was used as activator solution. Coupling times were 10 minutes (RNA), 90 seconds (2' O-Me), and 60 seconds (2' F). In order to introduce phosphorothioate linkages, a 100 mM solution of 3-phenyl 1,2,4-dithiazoline-5-one (POS, obtained from PolyOrg, Inc., Leominster, MA, USA) in anhydrous acetonitrile was employed.

Alternatively, tri-alkyne moieties were introduced post-synthetically (see section E, below). For this route, the sense strand was functionalized with a 5' and/or 3' terminal nucleotide containing a primary amine. TFA aminolink phosphoramidite was dissolved in anhydrous acetonitrile (50 mM) and molecular sieves (3A) were added. 5-Benzylthio-1H-tetrazole (BTT, 250 mM in acetonitrile) or 5-Ethylthio-1H-tetrazole (ETT, 250 mM in acetonitrile) was used as activator solution. Coupling times were 10 minutes (RNA), 90 seconds (2' O-Me), and 60 seconds (2' F). In order to introduce phosphorothioate linkages, a 100 mM solution of 3-phenyl 1,2,4-dithiazoline-5-one (POS, obtained from PolyOrg, Inc., Leominster, MA, USA) in anhydrous acetonitrile was employed.

B. Cleavage and deprotection of support bound oligomer. After finalization of the solid phase synthesis, the dried solid support was treated with a 1:1 volume solution of 40 wt. % methylamine in water and 28% to 31% ammonium hydroxide solution (Aldrich) for 1.5 hours at 30° C. The solution was evaporated and the solid residue was reconstituted in water (see below).

C. Purification. Crude oligomers were purified by anionic exchange HPLC using a TSKgel SuperQ-5PW 13 μm column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC using a GE Healthcare XK 16/40 column packed with Sephadex G-25 fine with a running buffer of 100 mM ammonium bicarbonate, pH 6.7 and 20% Acetonitrile or filtered water. Alternatively, pooled fractions were desalted and exchanged into an appropriate buffer or solvent system via tangential flow filtration.

D. Annealing. Complementary strands were mixed by combining equimolar RNA solutions (sense and antisense) in 1×PBS (Phosphate-Buffered Saline, 1×, Corning, Cellgro) to form the RNAi agents. Some RNAi agents were lyophilized and stored at −15 to −25° C. Duplex concentration was determined by measuring the solution absorbance on a UV-Vis spectrometer in 1×PBS. The solution absorbance at 260 nm was then multiplied by a conversion factor (0.050 mg/(mL·cm)) and the dilution factor to determine the duplex concentration.

E. Synthesis of Lipids

If lipids described herein are not included in Example 1E, it is to be assumed that the compounds are commercially available or may be readily obtained by contracting with standard commercial manufacturers. For example, LP395p and LP396p were purchased commercially.

Synthesis of LP-183 phosphoramidite

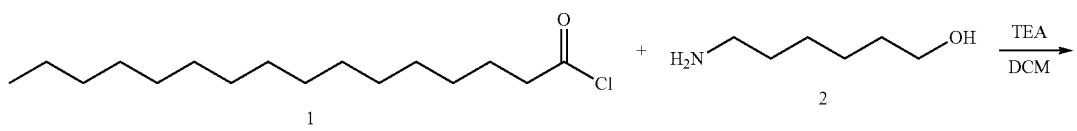

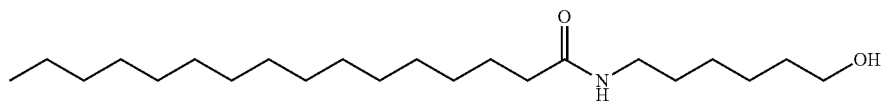

To a solution of compound 2 (2.00 g) in DCM was added TEA (2.27 mL) followed by compound 1 (4.931 g) dropwise at room temperature. Then the mixture was stirred at room temperature for 2 h. The mixture was then filtered. The white solid was dried overnight. Product is as white solid, yield, 4.267 g, 74%. LC-MS: calculated [M+H] 356.35, found 356.63.

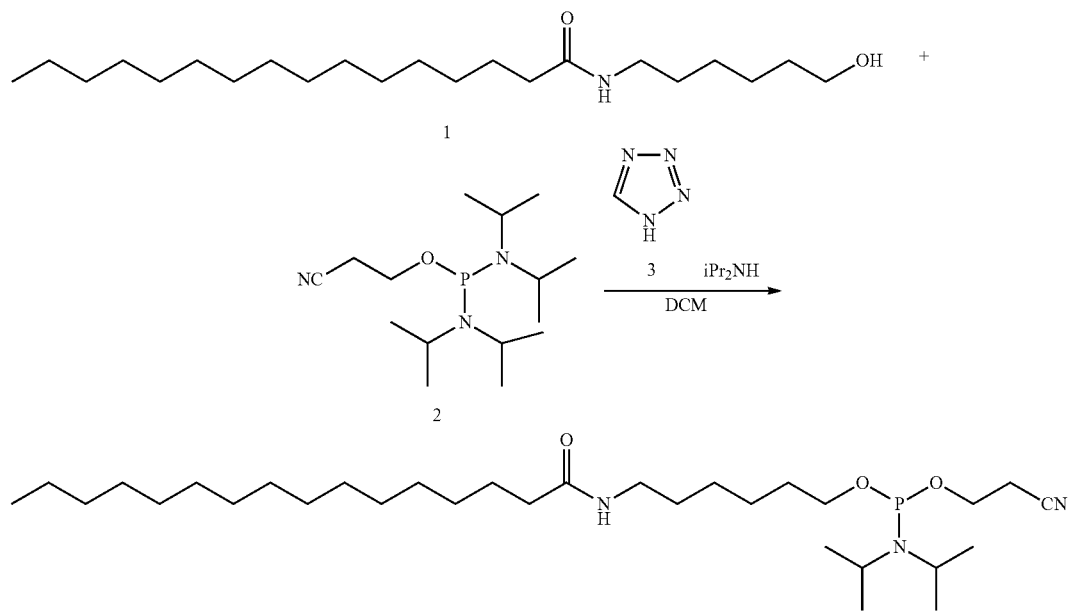

To a mixture of compound 1 (2.54 g) in 120 mL DCM was added compound 3 (0.61 g) followed by compound 2 (5.37 g) dropwise at room temperature. Then the mixture was stirred at room temperature overnight. 5 mL TEA was added followed by Celite. After removing solvent in vacuo, the residue was loaded on a 40 g column by dry method. Hexanes (2% TEA) to 50% EtOAc (2% TEA) in Hexanes (2% TEA) as gradient was used to purify the product. Product is a white waxy solid, yield 3.462 g, 87%. LC-MS: calculated [M+H] 556.46, found 556.64.

Synthesis of LP-183r-p

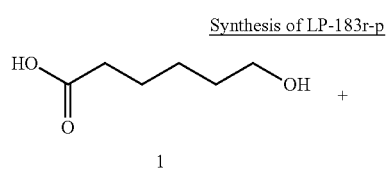

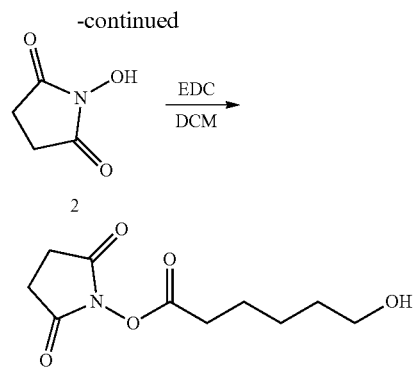

To a solution of Compound 1 (312 mg) in 10 mL DCM was added Compound 2 (299 mg) and EDC (498 mg) at RT. The reaction mixture was stirred at RT for 1 h. After removing solvent in vacuo, the residue was dry loaded on a 12 g column. Hexanes to EtOAc was used as the mobile phase. Product is a clear oil, 408 mg, 75% yield. LC-MS: calculated [M+H]230.10, found 230.34.

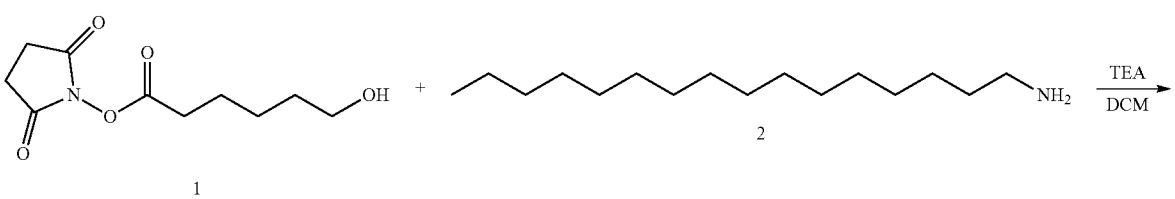

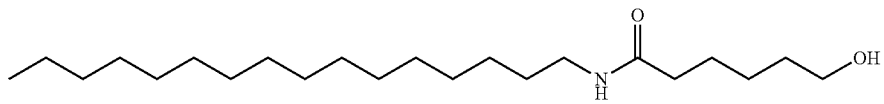

To a solution of compound 1 (408 mg) in 20 mL DCM was added compound 2 (516 mg) and TEA (0.745 mL) at RT. The reaction mixture was stirred at RT overnight. After removing solvent in vacuo, the residue was recrystalized in MeOH. Product is a white solid, 555 mg, 88% yield. LC-MS: calculated [M+H] 356.35, found 356.45.

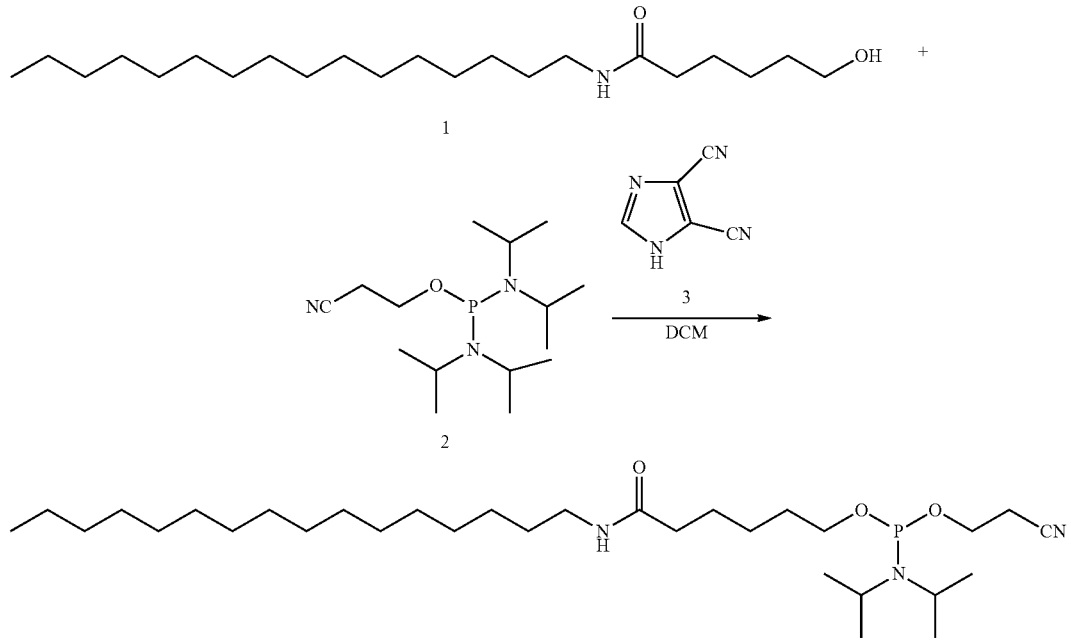

To a mixture of compound 1 (200 mg) in 10 mL DCM was added compound 3 (33.2 mg) followed by compound 2 (339 mg) dropwise at RT. Then the mixture was stirred at RT overnight. 1 mL TEA was added followed by some Celite®. After removing solvent in vacuo, the residue was dry loaded on a 4 g column. Hexanes (2% TEA) to 50% EtOAc (2% TEA) in Hexanes (2% TEA) as gradient was used as the mobile phase. Product is a white wax solid, 95 mg, 30% yield. LC-MS: calculated [M+H] 556.46, found 556.82.

Synthesis of LP232-p

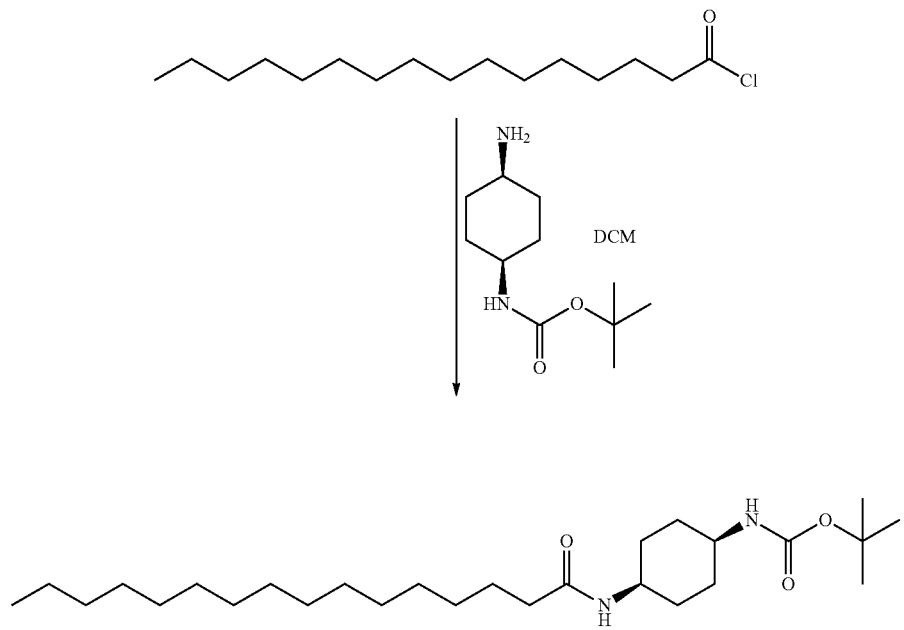

Palmitoyl chloride (100 mg) was stirred in a solution of cis-4-(boc-amino)cyclohexylamine (0.0819 g) in 5 mL DCM. After stirring the suspension overnight, water was added and the organics were extracted using DCM and dried over Na$_2$SO$_4$. After filtration, the solvent was concentrated to dryness and the crude product was purified by cloumn (Hexanes to EtOAc). Product is 52 mg, 31%.

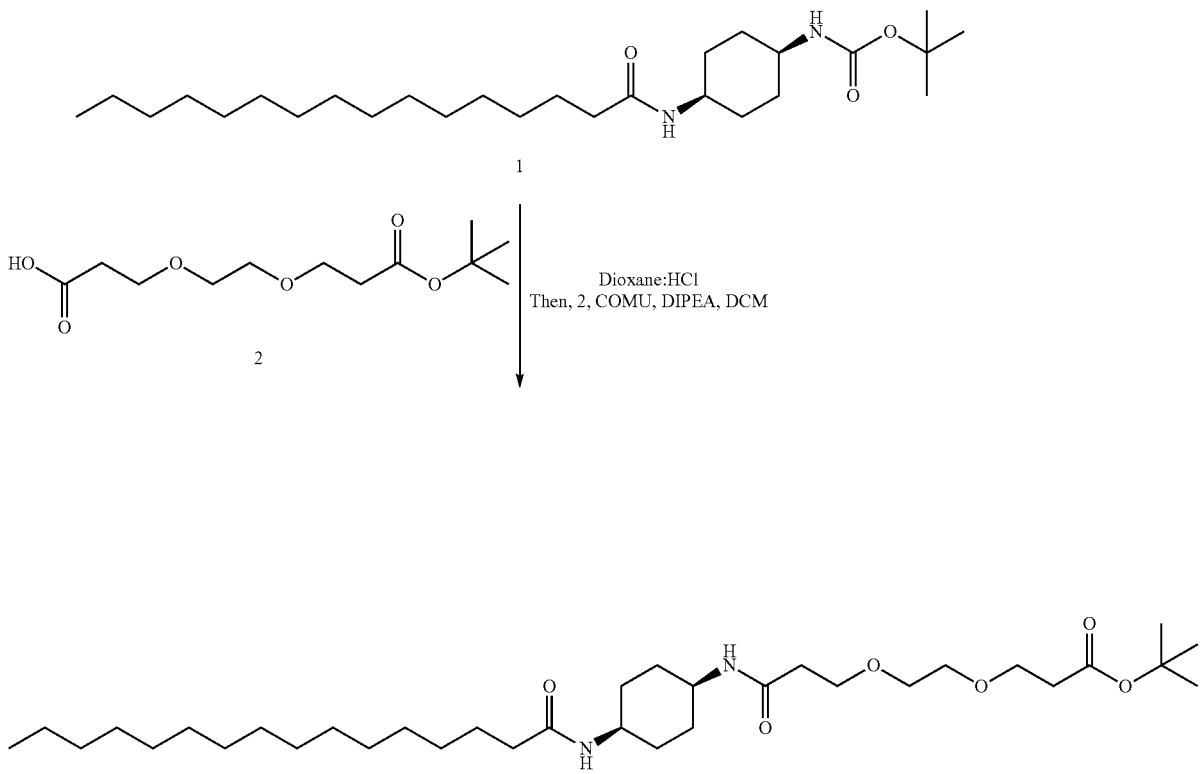

To 1 (0.0520 g) was added 2 mL Dioxane:HCl (4N) until boc deprotection was complete. After removing solvent in vacuo, to the residue was stirred in a solution of 2 (0.0316 g), DIPEA (0.0445 g) and COMU (0.0620 g) in 5 mL DCM. After stirring the suspension overnight, water was added and the organics were extracted using DCM and dried over Na$_2$SO$_4$. After filtration, the solvent was concentrated to dryness and the crude product was purified by column (DCM to 20% MeOH in DCM). Product was 45 mg, 65%.

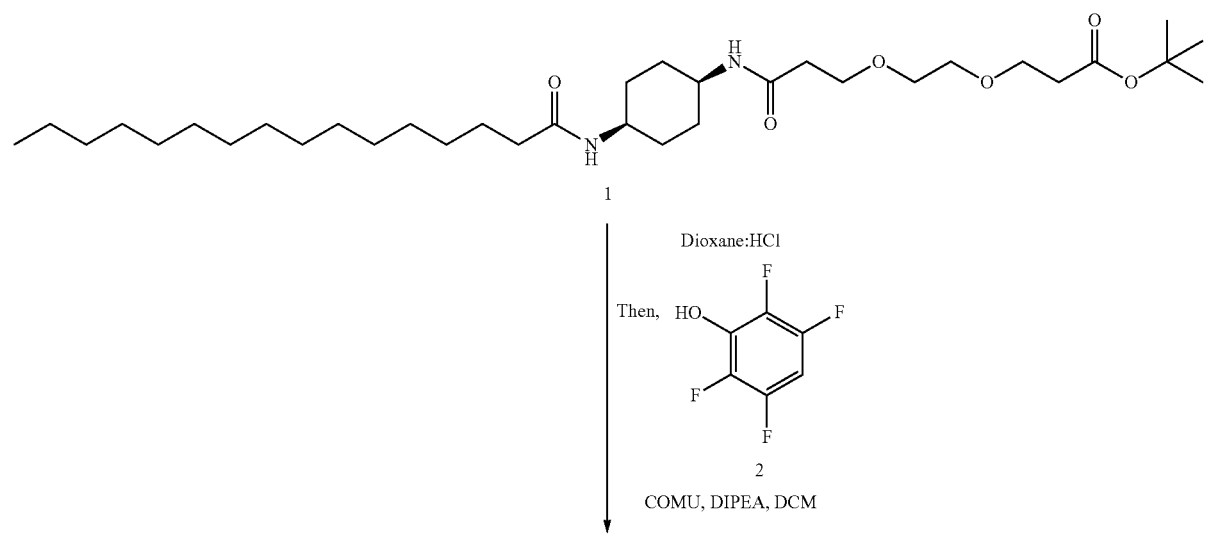

-continued

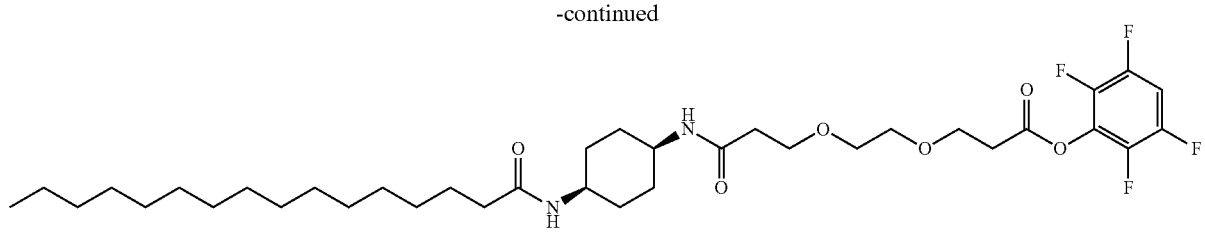

To 1 (0.0449 g) was added 2 mL Dioxane:HCl (4N) until OtBu deprotection was complete. After removing solvent in vacuo, to the residue was stirred in a solution of 2 (0.0217 g), DIPEA (0.039 mL) and COMU (0.0425 g) in 5 mL DCM. After stirring the suspension overnight, water was added and the organics were extracted using DCM and dried over $Na_2SO_4$. After filtration, the solvent was concentrated to dryness and the crude product was purified by column (DCM to 20% MeOH in DCM). Product was 30 mg, 58%.

Synthesis of LP233-p

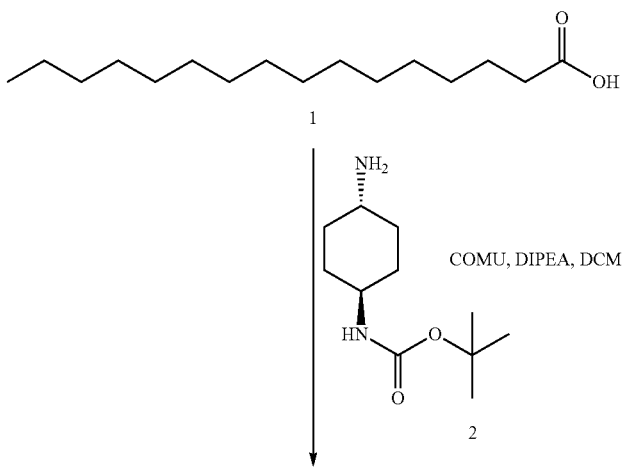

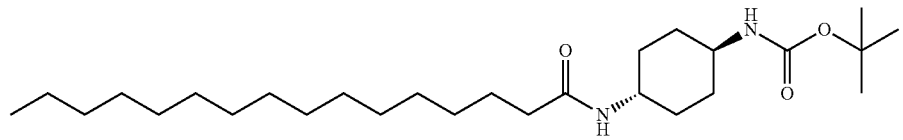

Palmitic acid 1 (0.100 g) was stirred in a solution of 2 (0.0693 g), COMU (0.166 g), DIPEA (0.16 mL), in 5 mL DCM. After stirring the suspension overnight (heated at 40° C.), water was added and the organics were extracted using DCM and dried over $Na_2SO_4$. After filtration, the solvent was concentrated to dryness and the crude product was purified by column (Hexanes to EtOAc). Product was 96 mg, 69%.

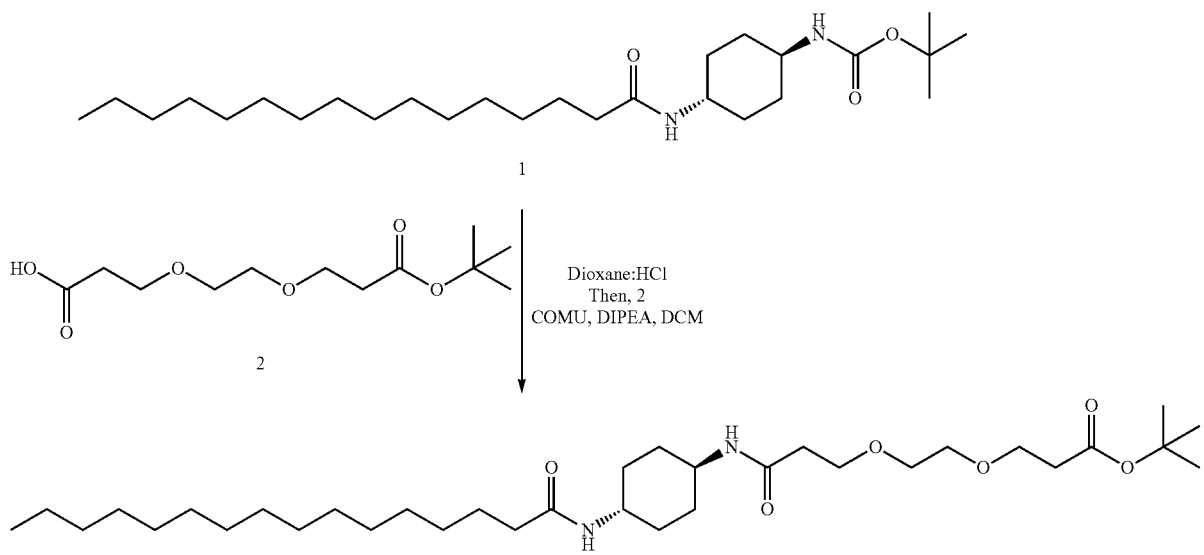

To 1 (0.0955 g) was added 2 mL Dioxane:HCl (4N) until boc deprotection was complete. After removing solvent in vacuo, to the residue was stirred in a solution of 2 (0.0581 g), DIPEA (0.11 mL) and COMU (0.114 g) in 5 mL DCM. After stirring the suspension overnight, water was added and the organics were extracted using DCM and dried over $Na_2SO_4$. After filtration, the solvent was concentrated to dryness and the crude product was purified by column (DCM to 20% MeOH in DCM). Product was 68 mg, 54%.

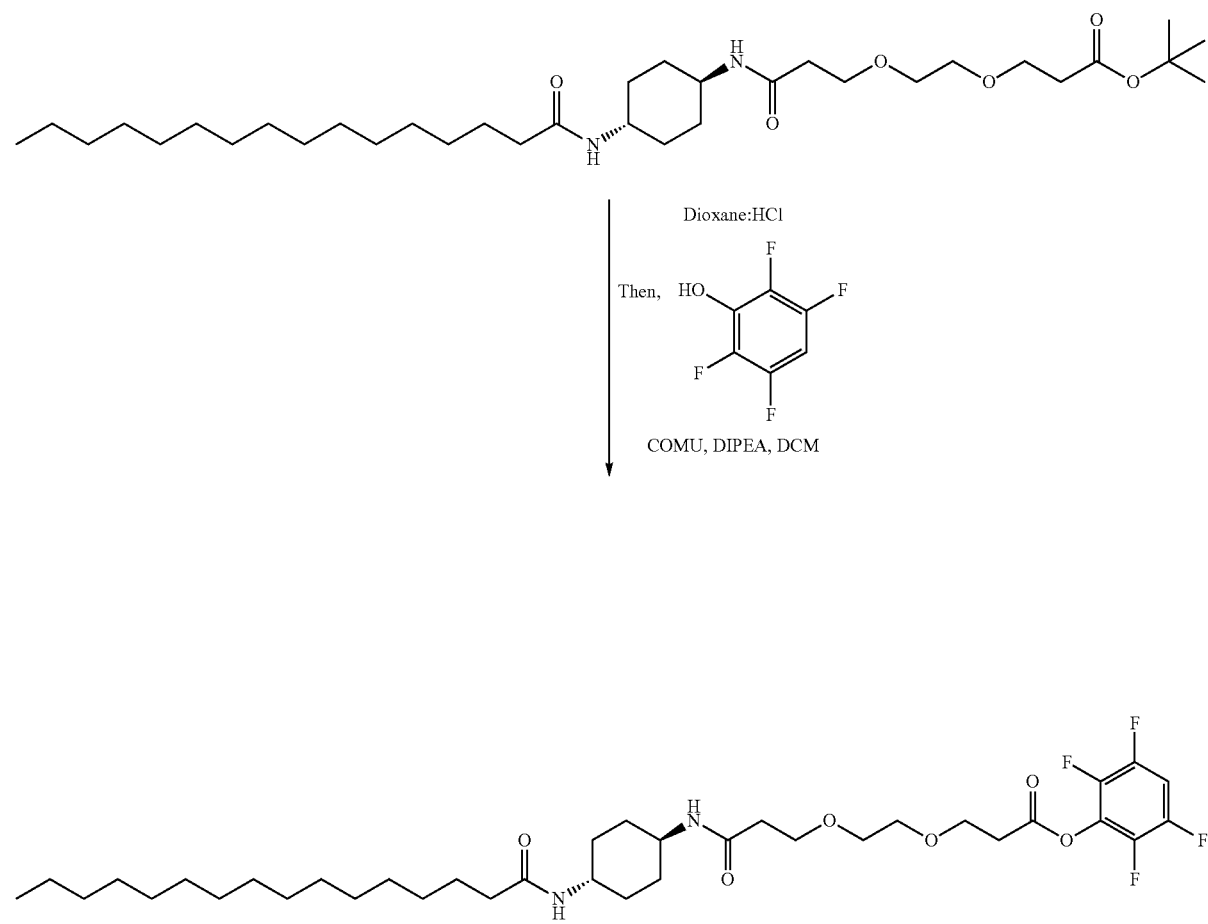

To 1 (0.068 g) was added 2 mL Dioxane:HCl (4N) until otBu deprotection was complete. After removing solvent in vacuo, to the residue was stirred in a solution of tetrafluorophenol (0.021 g), DIPEA (0.059 mL) and COMU (0.064 g) in 5 mL DCM. After stirring the suspension overnight, water was added and the organics were extracted using DCM and dried over $Na_2SO_4$. After filtration, the solvent was concentrated to dryness and the crude product was purified by column (DCM to 20% MeOH in DCM). Product was 22 mg, 28%.

Synthesis of LP242-p

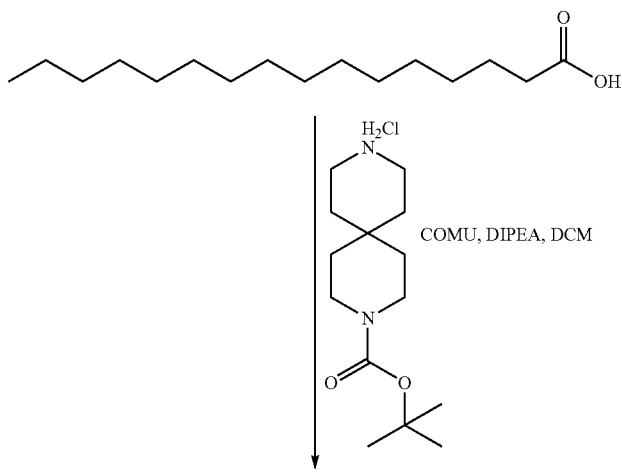

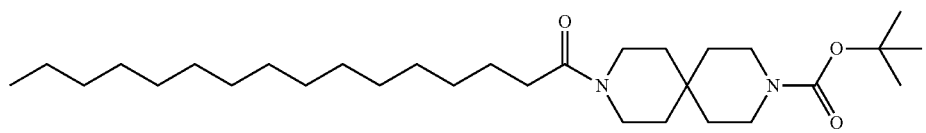

Palmitic acid (0.100 g) was stirred in a solution of tBu-3,9diazaspiro[5,5]undecane-3-carboxylate HCl (0.073 g), COMU (0.166 g), DIPEA (0.16 mL), in 5 mL DCM. After stirring the suspension overnight (heated at 40° C.), water was added and the organics were extracted using DCM and dried over $Na_2SO_4$. After filtration, the solvent was concentrated to dryness and the crude product was purified by flash chromatography.

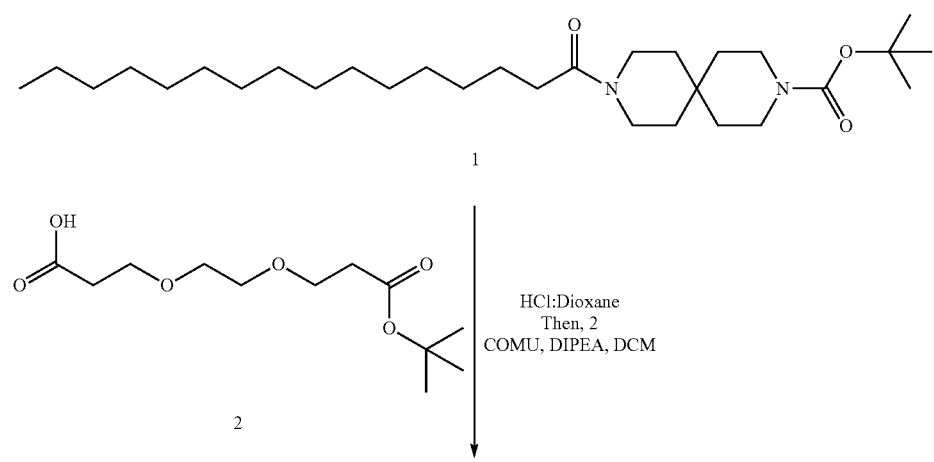

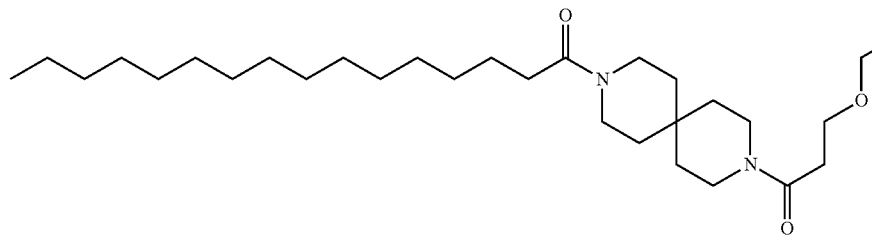
1 (0.017 g) was treated with HCl:Dioxane and after 1 h, crude reaction was dried in vacuo. To this was added a solution of 2 (0.0095 g), COMU (0.0186 g), DIPEA (0.0134 g), in 5 mL DCM. After stirring the suspension, water was added and the organics were extracted using DCM and dried over $Na_2SO_4$. After filtration, the solvent was concentrated to dryness and the crude product was purified by flash chromatography.
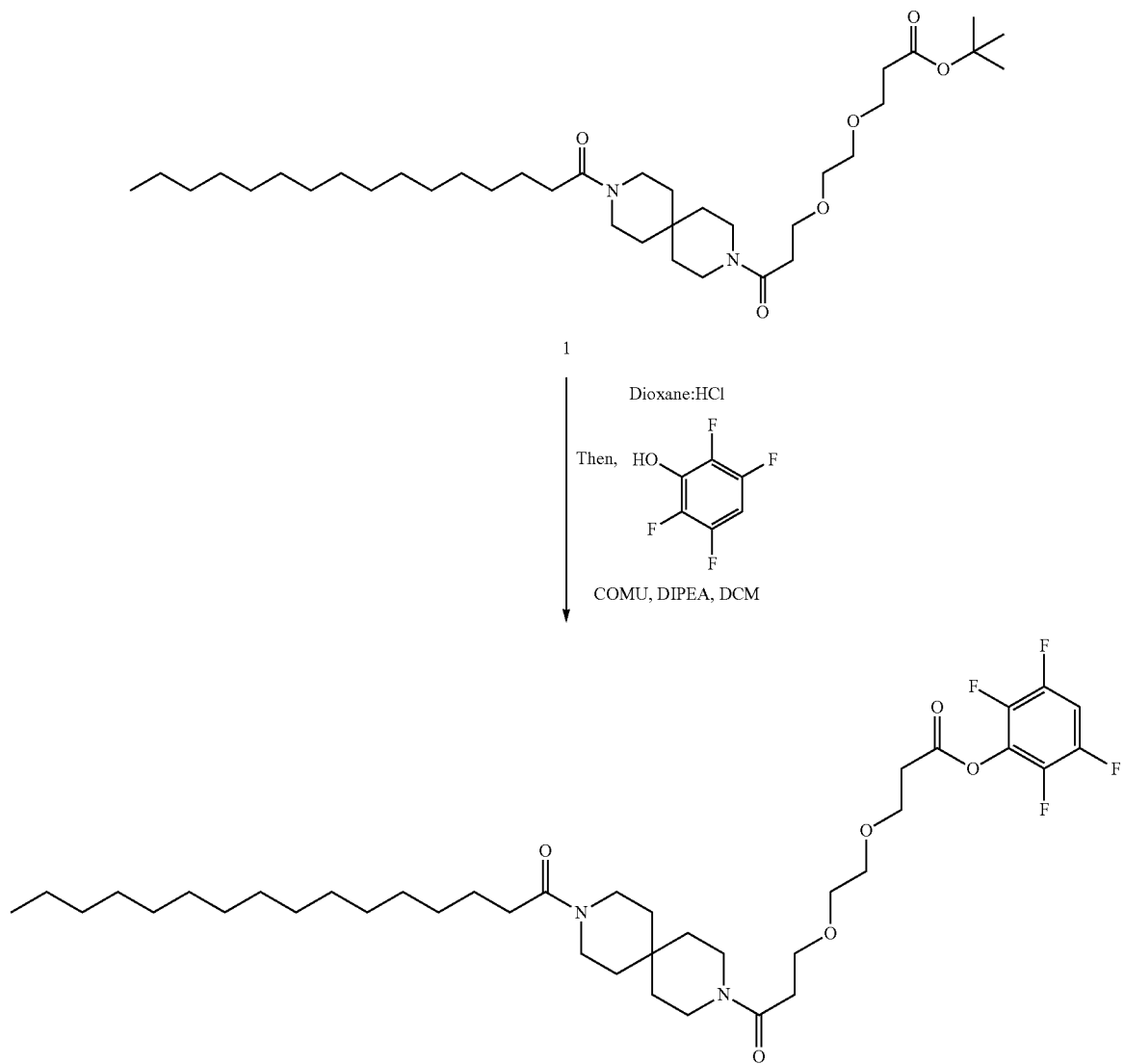

To 1 (0.121 G) was added 2 mL Dioxane:HCl (4N) until otBu deprotection was complete. After removing the solvent in vacuo, to crude 1 was stirred in a solution of tetrafluorophenol (0.0585 g), DIPEA (0.11 mL) and COMU (0.115 g) in 5 mL DCM. After stirring the suspension overnight, water was added and the organics were extracted using DCM and dried over $Na_2SO_4$. After filtration, the solvent was concentrated to dryness and the crude product was purified by flash chromatography.

Synthesis of LP243-p

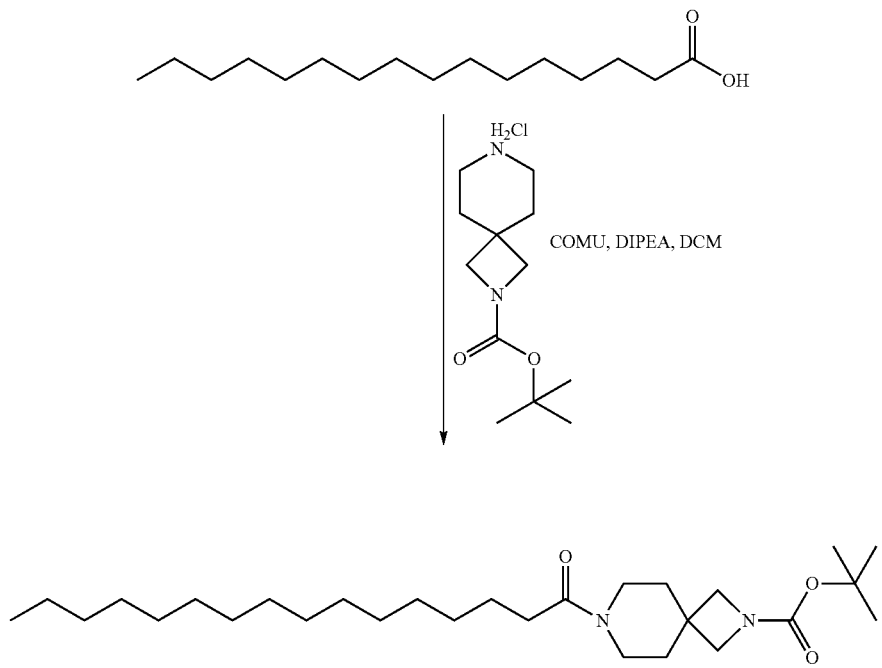

To palmitic acid (0.100 g) was stirred in a solution of tBu-3,9diazaspiro[5,5]undecane-3-carboxylate HCl (0.0732 g), COMU (0.166 g), DIPEA (0.161 mL), in 5 mL DCM. After stirring the suspension overnight (heated at 40° C.), water was added and the organics were extracted using DCM and dried over $Na_2SO_4$. After filtration, the solvent was concentrated to dryness and the crude product was purified by flash chromatography.

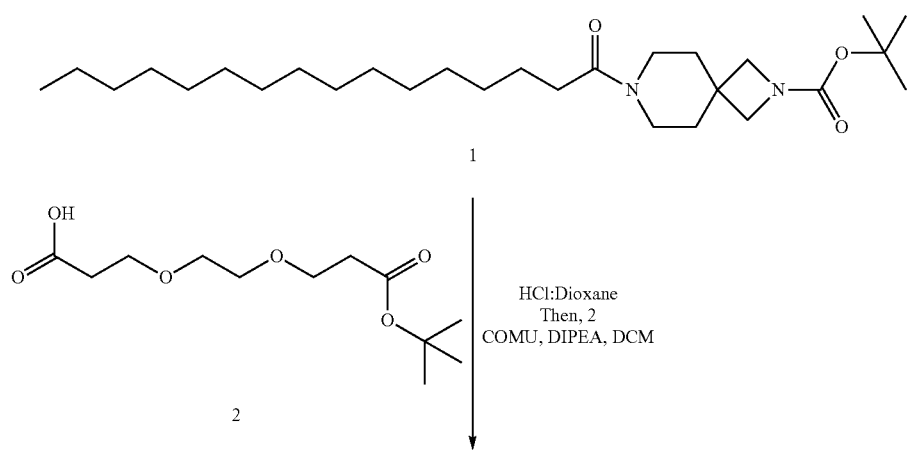

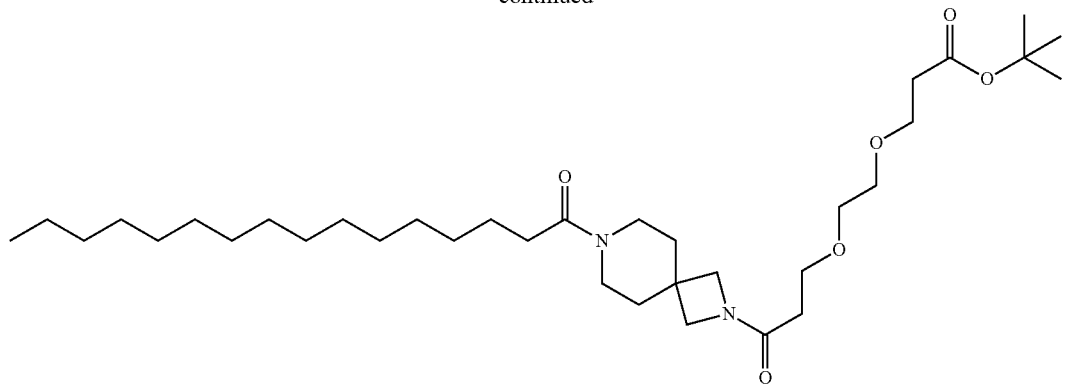
1 (0.0200 g) was treated with HCl:Dioxane and after 1 h, crude reaction was dried in vacuo. To this was added a solution of 2 (0.0119 g), COMU (0.0232 g), DIPEA (0.022 mL), in 5 mL DCM. After stirring the suspension, water was added and the organics were extracted using DCM and dried over $Na_2SO_4$. After filtration, the solvent was concentrated to dryness and the crude product was purified by flash chromatography.
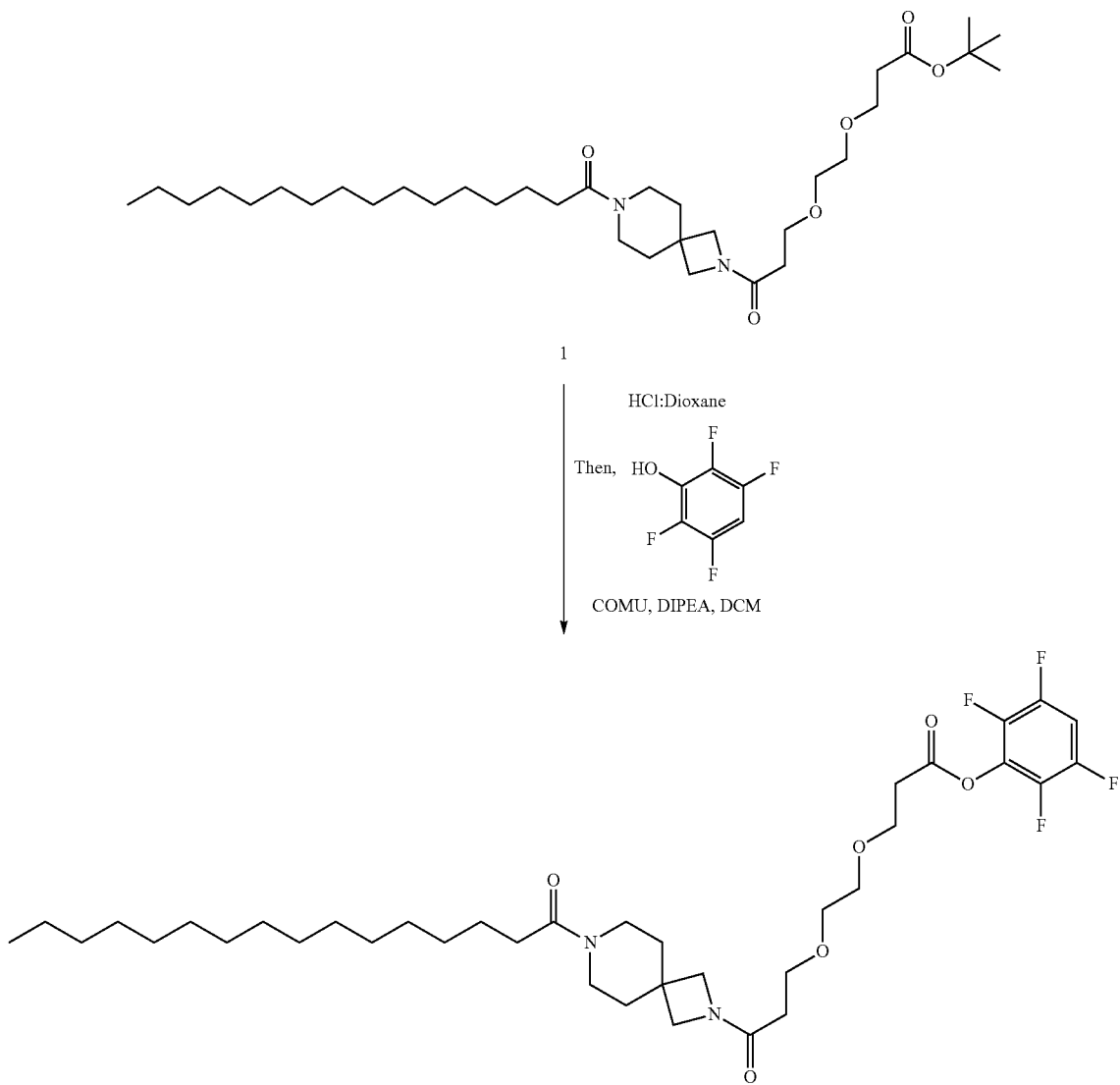

To 1 (0.121 g) was added 2 mL Dioxane:HCl (4N) until otBu deprotection was complete. After removing the solvent in vacuo, crude 1 was stirred in a solution of tetrafluorophenol (0.0363 g), DIPEA (0.104 mL) and COMU (0.112 g) in 5 mL DCM. After stirring the suspension overnight, water was added and the organics were extracted using DCM and dried over $Na_2SO_4$. After filtration, the solvent was concentrated to dryness and the crude product was purified by flash chromatography.

Synthesis of LP245-p

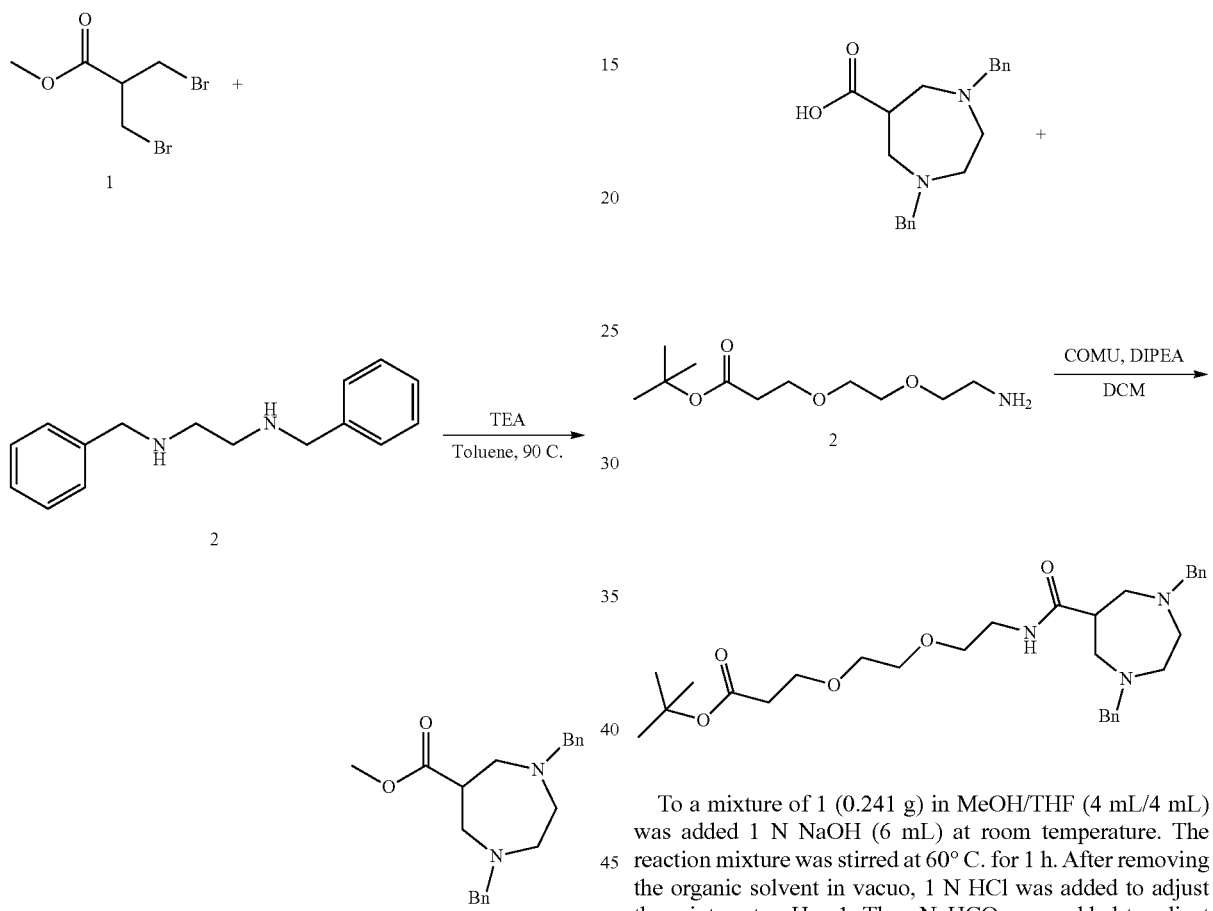

To a mixture of 1 (2.08 g) and 2 (1.98 g) in 50 mL toluene was added TEA at room temperature. The reaction mixture was stirred at 90° C. overnight. After cooling to room temperature, EtOAc and water were added for workup. Purification was on a 40 g column. Hexanes to 30% EtOAc in Hexanes as gradient was used to purify. Product was a light yellow oil, 1388 mg, 51%. LC-MS: calculated [M+H] 339.21, found 339.62.

To a mixture of 1 (0.241 g) in MeOH/THF (4 mL/4 mL) was added 1 N NaOH (6 mL) at room temperature. The reaction mixture was stirred at 60° C. for 1 h. After removing the organic solvent in vacuo, 1 N HCl was added to adjust the mixture to pH ~ 1. Then $NaHCO_3$ was added to adjust pH between 7-8. DCM was added to workup. After removing DCM in vacuo, the residue was placed on high vacuum for 2h. The residue was diluted by DCM, then DIPEA (0.248 mL), COMU (0.336 g) and 2 (0.166 g) were added. The reaction mixture was stirred at room temperature for 2h. The reaction mixture was washed with 1 N HCl, $NaHCO_3$ and brine. Purification was on a 12 g column. Hexanes to EtOAc as gradient was used to purify. Product was a brown oil, 285 mg, 74%. LC-MS: calculated [M+H] 540.34, found 541.07.

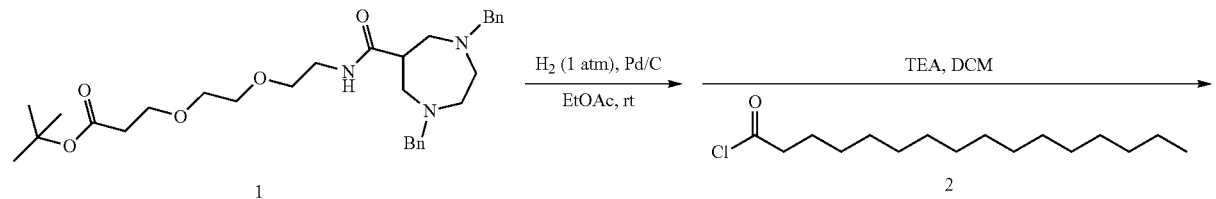

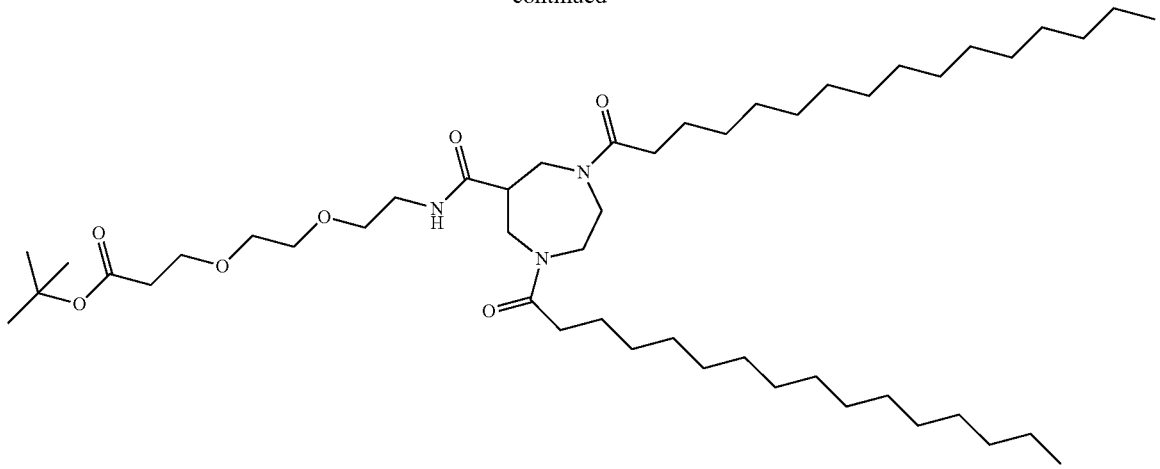

To a mixture of 1 (0.0740 g) and Pd/C in EtOAc was charged with $H_2$ (1 atm) at room temperature. The reaction mixture was stirred at room temperature for 4h. The reaction mixture was filtered by a Celite® pad. After removing EtOAc in vacuo, the residue was under high vacuum for 1 h. The residue was dissolved in 3 mL DCM, 2 (0.166 mL) and TEA (0.115 mL) were added at room temperature. The mixture was stirred at room temperature for 2h. Water was added for workup. Purification was on a 12 g column. DCM to 20% MeOH in DCM as gradient was used to purify. Product was a clear oil, 43 mg, 37%. LC-MS: calculated [M+H] 836.71, found 837.68.

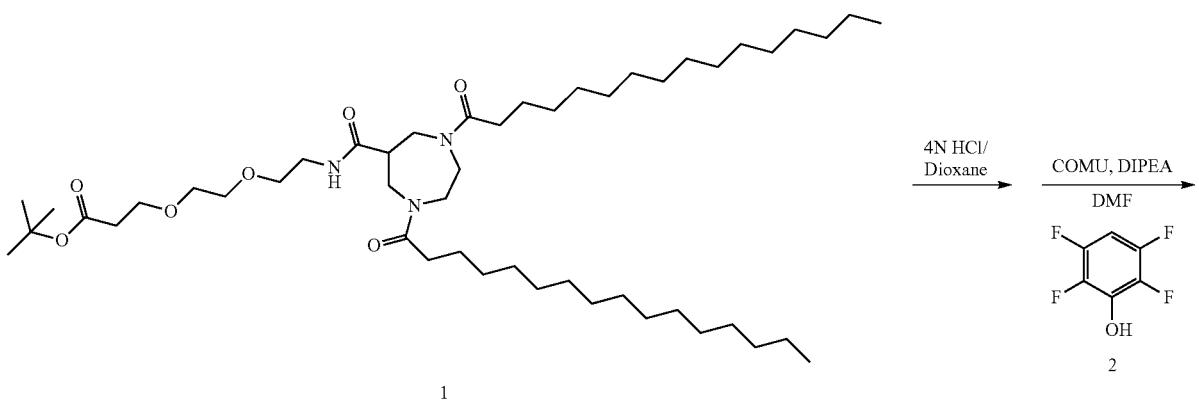

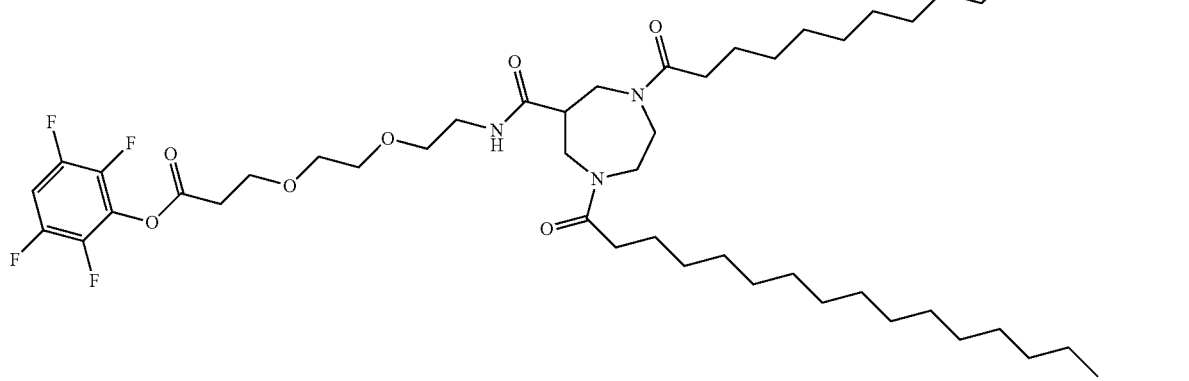

A solution of 1 (0.0430 g) in 4N HCl/Dioxane (3 mL) was stirred at room temperature overnight. After removing solvent in vacuo, the residue was placed under high vacuum for 3h. The residue was dissolved in 3 mL DMF, then, DIPEA (0.027 g), COMU (0.0660 g) and 2 (0.017 g) were added. The mixture was stirred at room temperature for 2h. After removing solvent in vacuo, the residue was loaded on a 4 g column. DCM to 20% MeOH in DCM as gradient was used to purify. Product was a light yellow oil, 34 mg, 37%. LC-MS: calculated [M+H] 928.64, found 929.59.

Synthesis of LP249-p

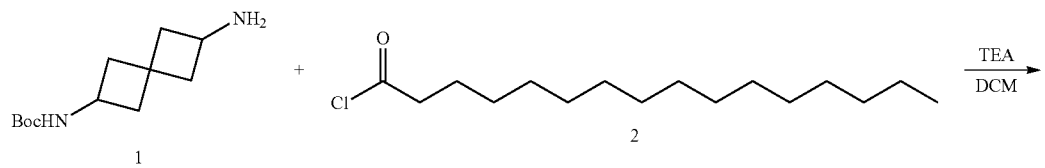

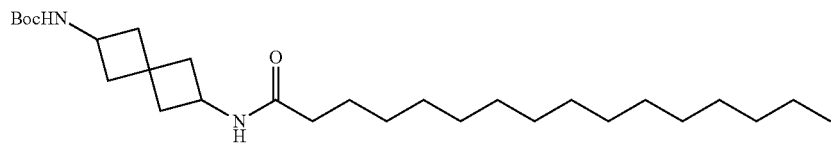

To a mixture of 1 (0.0600 g) and 2 (0.161 mL) in 4 mL DCM was added TEA (0.111 mL) at room temperature. The reaction mixture was stirred at room temperature for 2h. Water was added for workup. Purification was on a 4 g column. Hexanes to EtOAc as gradient was used to purify. Product was a white solid, 74 mg, 60%. LC-MS: calculated [M+H] 465.41, found 465.91.

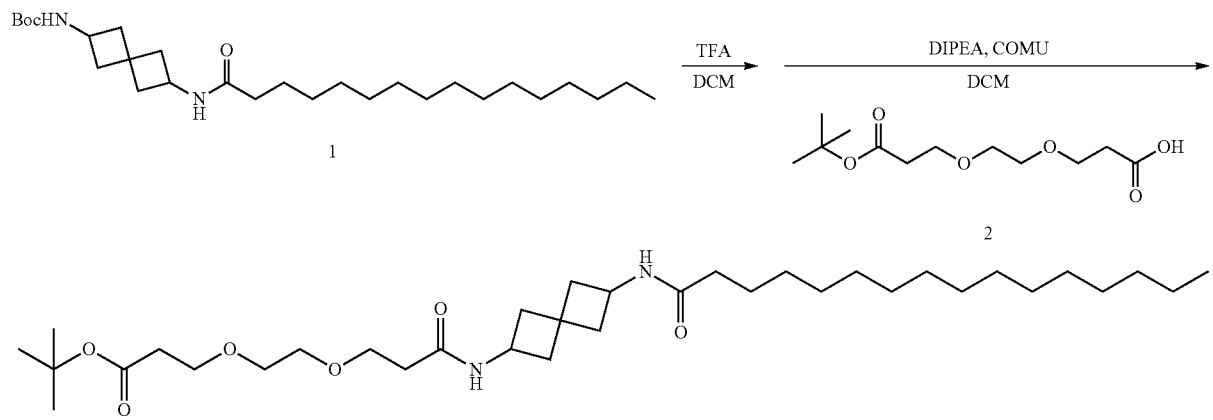

To a solution of 1 (0.0740 g) in DCM was added TFA (50% in DCM) at room temperature. The reaction mixture was stirred at room temperature for 0.5h. The solvent was removed in vacuo, then the residue was under high vacuum for 2h. The residue was dissolved in DMF, then 2 (0.0420 g), DIPEA (0.084 mL) and COMU (0.102 g) were added at room temperature. The mixture was stirred at room temperature for 2h. The solvent was removed in vacuo. Purification was on a 12 g column. DCM to 20% MeOH in DCM as gradient was used to purify. Product was a white solid, 56 mg, 58%. LC-MS: calculated [M+H] 609.48, found 610.29.

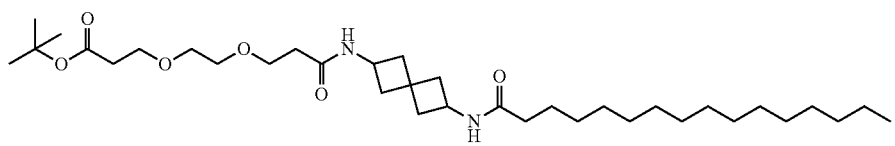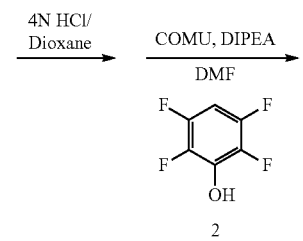

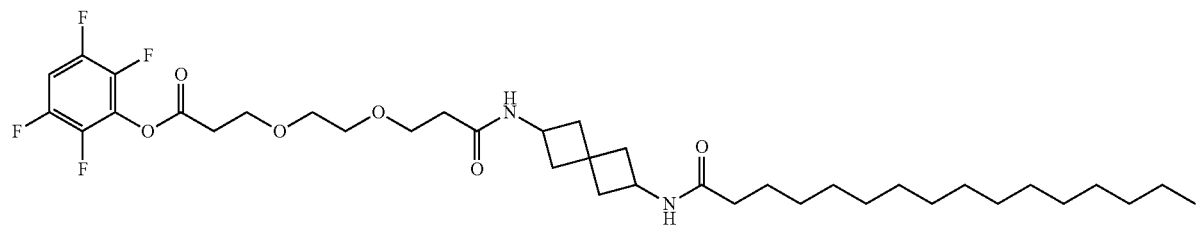

The solution of 1 (0.0560 g) in 4N HCl/Dioxane (3 mL) was stirred at room temperature overnight. After removing solvent in vacuo, the residue was under high vacuum for 3h. The residue was dissolved in 2 mL DMF, then, DIPEA (0.048 mL), COMU (0.118 g) and 2 (0.031 g) were added. The mixture was stirred at room temperature for 2h. After removing solvent in vacuo, the residue was loaded on a 4 g column. DCM to 20% MeOH in DCM as gradient was used to purify. Product was an off-white solid, 16 mg, 25%. LC-MS: calculated [M+H] 701.42, found 702.20.

Synthesis of LP257-p

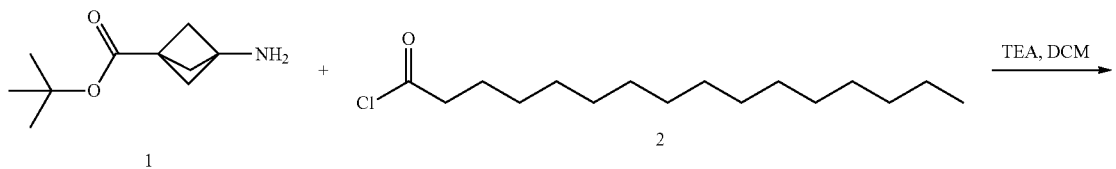

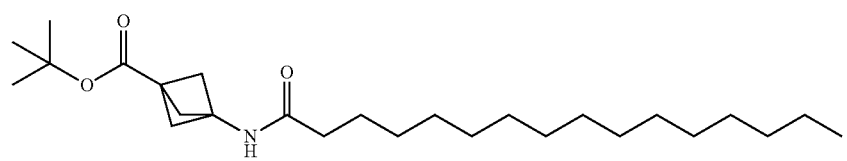

The solution of 1 (0.100 g) in 3 mL DCM was added 2 (0.331 mL) and TEA (0.304 mL) at room temperature. The reaction was stirred at room temperature for 1 h. EtOAc was added to dilute, then the mixture was washed with 1 N HCl, NaHCO$_3$ and brine. After removing the solvent in vacuo, the residue was loaded on a 4 g column. Hexanes to EtOAc as gradient was used to purify. Product was a white solid, 134 mg, 58%. LC-MS: calculated [M+H]: 422.36, found 422.79.

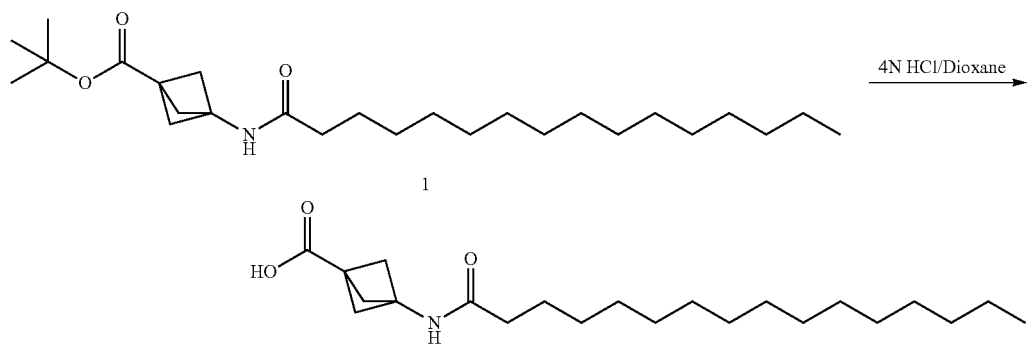

The solution of 1 (0.134 g) in 4N HCl/Dioxane (8 mL) was stirred at room temperature overnight. After removing solvent in vacuo, the residue was under high vacuum for 3h. Product was a white solid, 118 mg, which would be used for next step without further purification. LC-MS: calculated [M+H] 366.30, found 366.62.

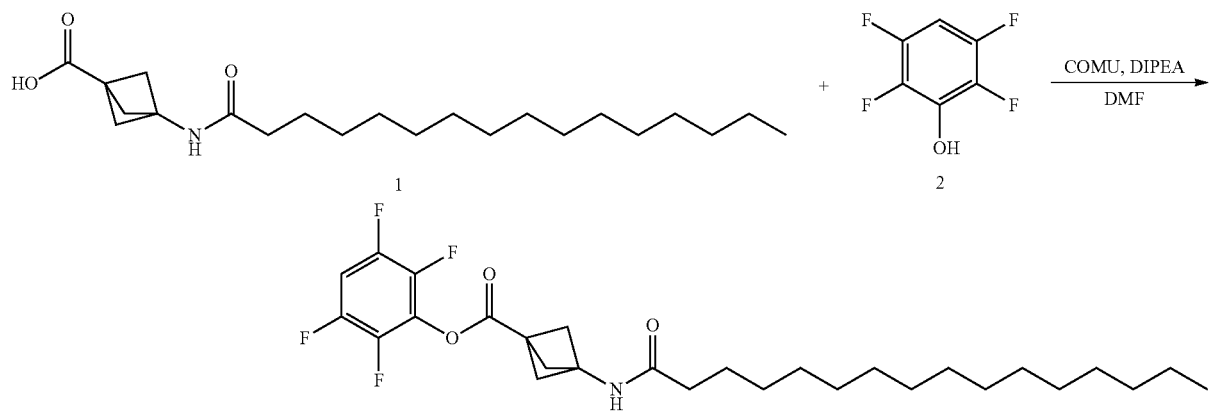

The solution of 1 (0.0490 g) in 3 mL DMF was added COMU (0.086 g), DIPEA (0.047 mL) and 2 (0.045 g) at room temperature. The mixture was stirred at room temperature for 1 h. The reaction mixture was diluted with EtOAc, then was washed with 1 N HCl, NaHCO₃ and brine. After removing solvent in vacuo, the residue was loaded on a 4 g column. Hexanes to EtOAc as gradient was used to purify. Product was a white solid, 23 mg, 33%. LC-MS: calculated [M+H] 514.29, found 514.79.

Synthesis of LP259-p

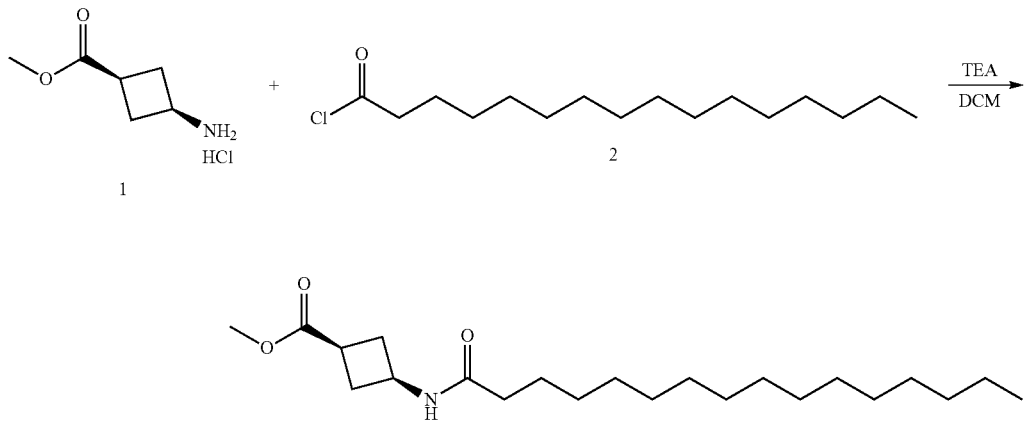

The solution of 1 (0.100 g) in 3 mL DCM was added 2 (0.366 mL) and TEA (0.337 mL) at room temperature. The reaction was stirred at room temperature for 1 h. The reaction mixture was loaded on a 12 g column. Hexanes to EtOAc as gradient was used to purify. Product was a white solid, 183 mg, 82%. LC-MS: calculated [M+H]: 368.32, found 368.60.

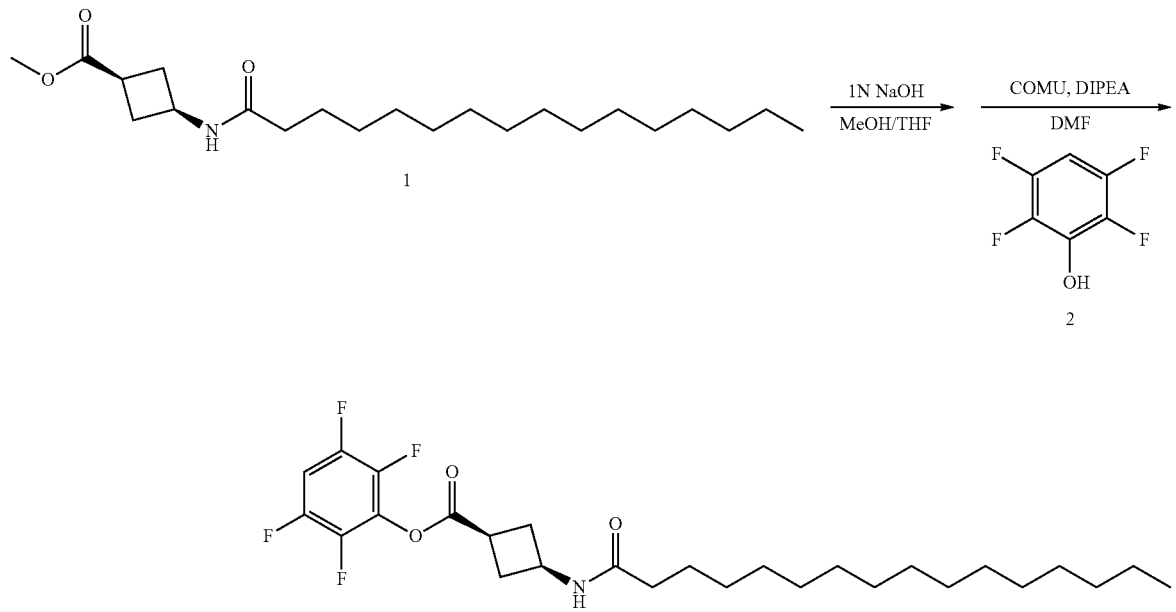

The solution of 1 (0.0900 g) in MeOH/THF/1 N NaOH (3 mL/3 mL/3 mL) was stirred at 60° C. for 1 h. After cooling to room temperature, the MeOH/THF was removed in vacuo. The pH was adjusted to ~1 with 1 N HCl. EtOAc and water were added to workup. After removing EtOAc in vacuo, the residue was under high vacuum for 3h. The residue was dissolved in 3 mL DMF, then COMU (0.136 g), DIPEA (0.085 mL) and 2 (0.053 g) were added at room temperature. The reaction was stirred at room temperature for 1 h. EtOAc was added to dilute the reaction mixture. The reaction mixture was washed with 1 N HCl, NaHCO₃ and brine. After removing EtOAc in vacuo, the residue was loaded on a 12 g column. Hexanes to EtOAc as gradient was used to purify. Product was a white solid, 87 mg, 71%. LC-MS: calculated [M+H]: 502.29, found 502.72.

Synthesis of LP260-p

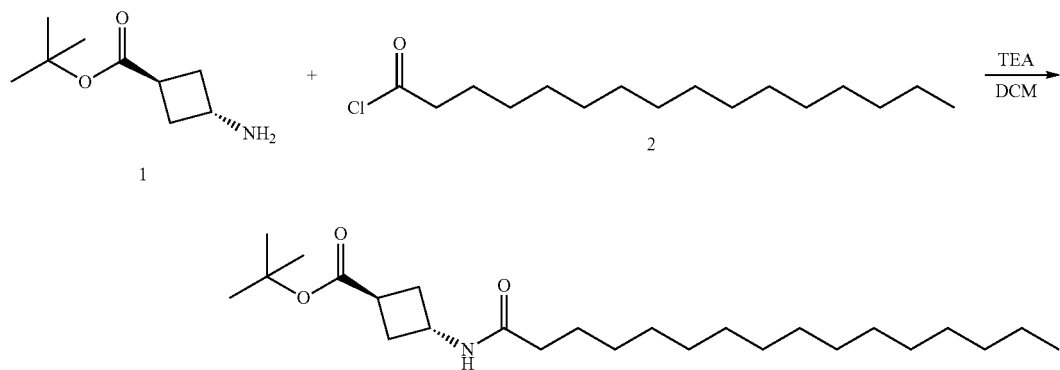

The solution of 1 (0.100 g) in DDC was added 2 (0.354 mL) and TEA (0.326 mL) at room temperature. The reaction was stirred at room temperature for 1 h. The reaction mixture was loaded on a 12 g column. Hexanes to EtOAc as gradient was used to purify. Product was a white solid, 208 mg, 87%. LC-MS: calculated [M+H]: 410.36, found 410.73.

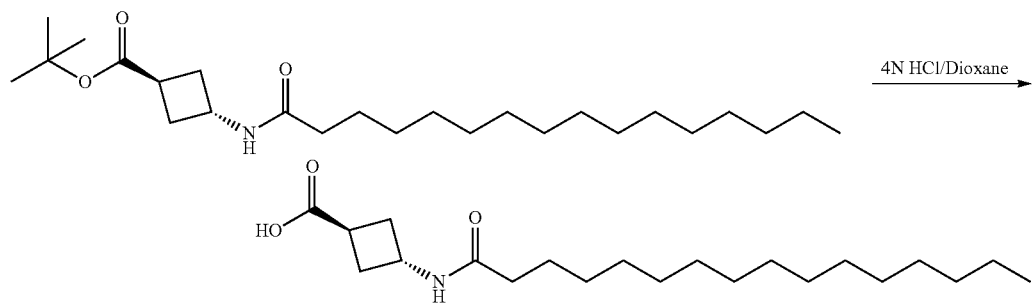

The solution of 1 (0.208 g) in 4N HCl/Dioxane (8 mL) was stirred at room temperature overnight. After removing solvent in vacuo, the residue was under high vacuum for 3h. Product was a white solid, 179 mg, which would be used for next step without further purification. LC-MS: calculated [M+H] 354.30, found 354.65.

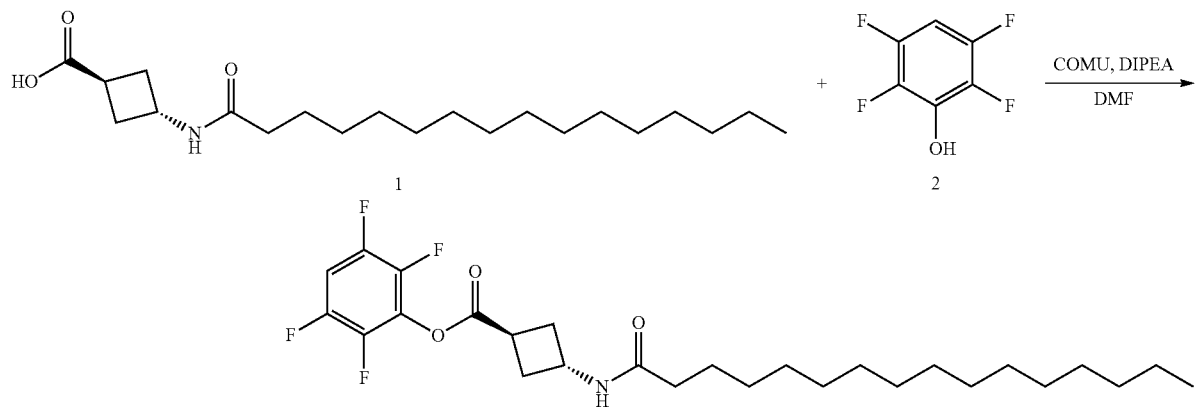

The solution of 1 (0.0760 g) in 3 mL DMF was added COMU (0.120 g), DIPEA (0.072 mL) and 2 (0.0460 g) at room temperature. The mixture was stirred at room temperature for 1 h. The reaction mixture was diluted with EtOAc, then was washed with 1 N HCl, NaHCO₃ and brine. After removing solvent in vacuo, the residue was loaded on a 12 g column. Hexanes to EtOAc as gradient was used to purify. Product was a white solid, 55 mg, 51%. LC-MS: calculated [M+H] 502.29, found 502.72.

Synthesis of LP262-p

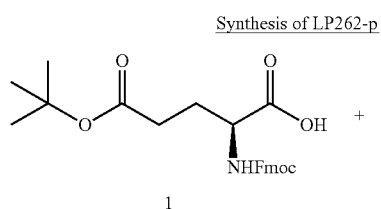

To a solution of 1 (0.0220 g) and 2 (0.100 g) and DIPEA (0.017 mL) in 2 mL DMF was added COMU (0.0240 g) at room temperature. The mixture was stirred at room temperature for 2h. The reaction mixture was diluted with DCM. Then it was washed with 1 N HCl, saturated NaHCO₃ and brine. Purification was performed on a 4 g column. DCM to 20% MeOH in DCM as gradient was used to purify. Product was a clear solid, 77 mg, 65%. LC-MS: calculated [M+2H]+ H₂O: 1294.76, found 1295.29; calculated [M+3H]+H₂O: 869.51, found 869.45; calculated [M+4H]: 638.88, found 638.54.

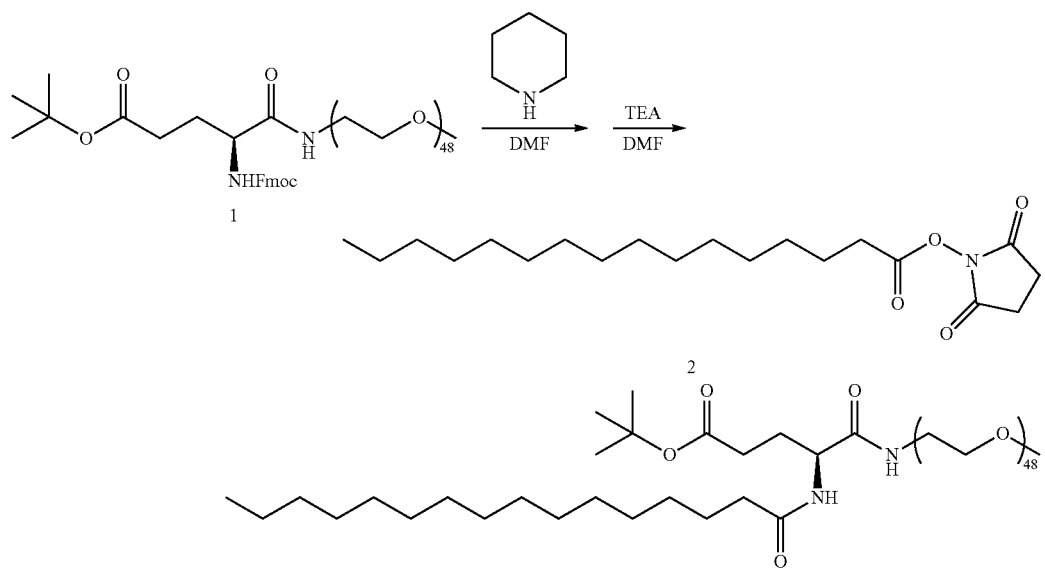

A solution of 1 (0.077 g) in DMF/piperidine (0.8 mL/0.2 mL) was stirred at room temperature for 1 h. After removing the solvent in vacuo, the residue was placed under high vacuum for 3h. The residue was dissolved in 3 mL DMF, then 2 (0.016 g) and TEA (0.013 mL) were added at room temperature. The reaction was stirred at room temperature for 1.5h. After removing the solvent in vacuo, the residue was loaded on a 4 g column. DCM to 20% MeOH in DCM as gradient was used to purify. Product was a white solid, 61 mg, 78%. LC-MS: calculated [M+2H]+H$_2$O: 1302.84, found 1303.81; calculated [M+4H]: 642.92, found 642.62.

The solution of 1 (0.0610 g) in 4N HCl/Dioxane (5 mL) was stirred at room temperature overnight. After removing the solvent in vacuo, the residue was placed under high vacuum for 3h. The residue was dissolved in 3 mL DMF, then COMU (0.0152 g), DIPEA (0.009 mL) and 2 (0.0060 g) were added at room temperature. The reaction was stirred at room temperature for 1.5h. After removing the solvent in vacuo, the residue was loaded on a 4 g column. DCM to 20% MeOH in DCM as gradient was used to purify. Product was a white solid, 13 mg, 21%. LC-MS: calculated [M+2H]+ H$_2$O: 1348.80, found 1348.94; calculated [M+3H]+H$_2$O: 905.54, found 905.09.

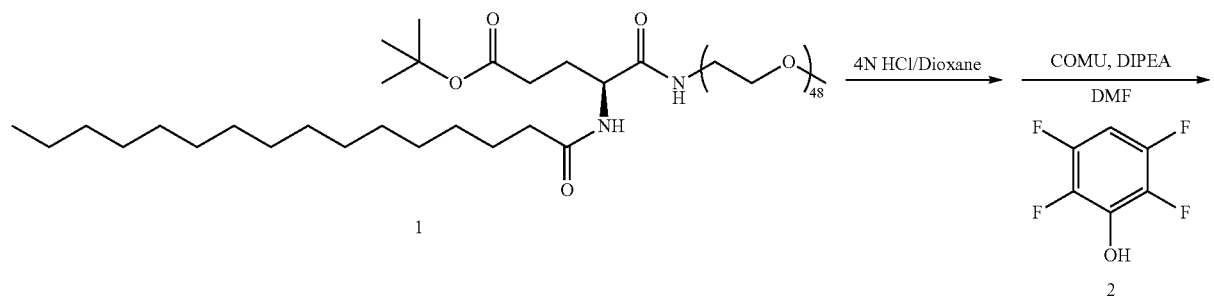

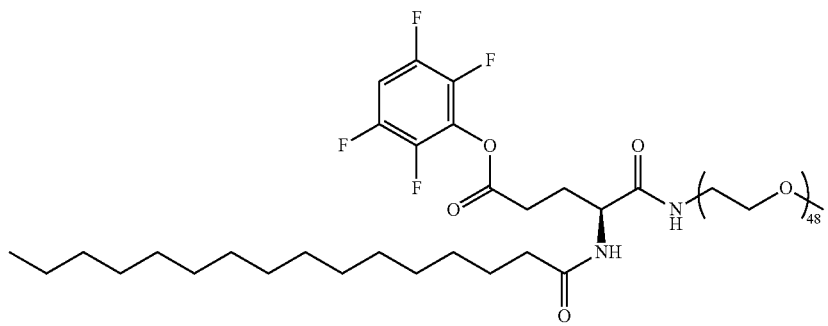

Synthesis of LP269-p

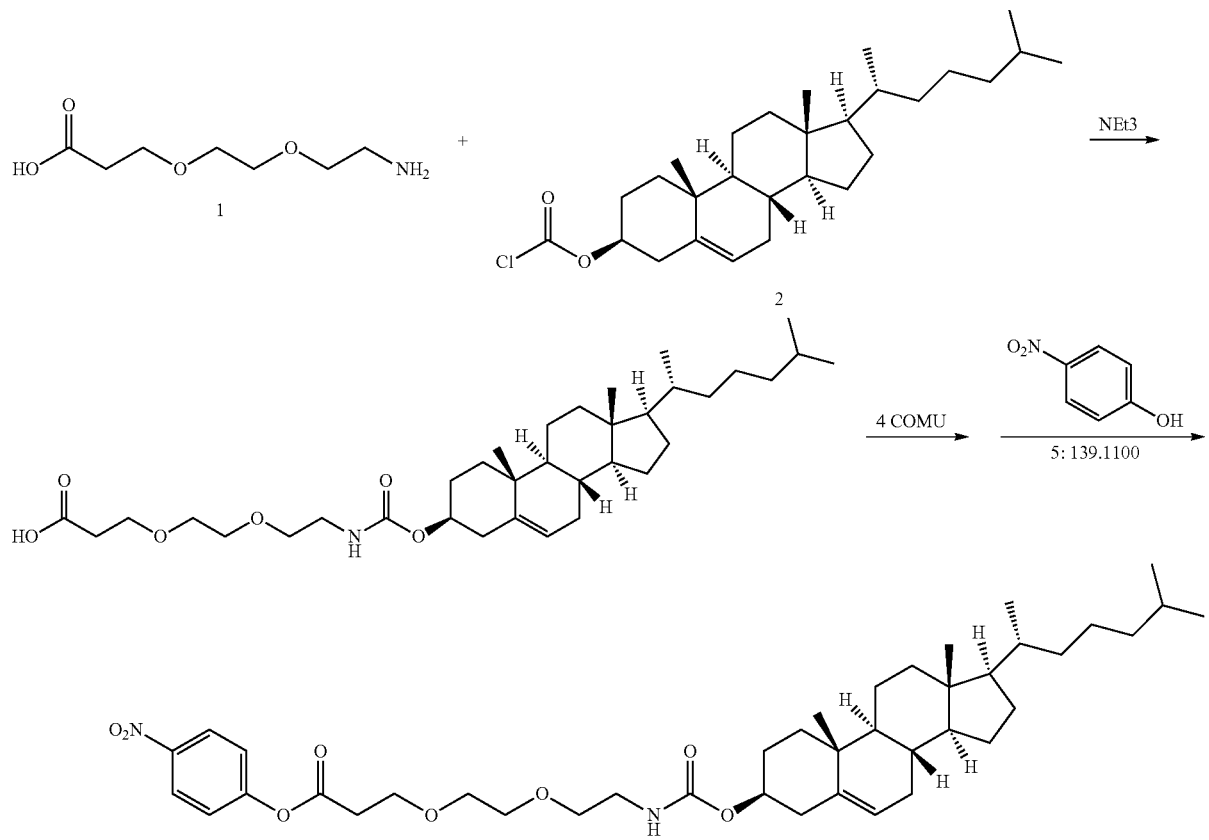

To a solution of 1 (88.6 mg, 0.500 mmol, 1.0 eqv.) and 2 (93.7 mg, 0.600 mmol, 1.20 eqv.) in 20 mL DCM was added TEA (0.418 mL, 3.000 mmol, 6.0 eqv.) under ambient conditions. Reaction was stirred at r.t. for 3 hours followed by adding COMU (257 mg, 0.600 mmol, 1.20 eqv.) then 4-nitrophenol (166.1 mg, 1.000 mmol, 2.0 eqv.). The reaction was stirred at r.t. overnight. The reaction mixture was washed with 1 N HCl, then brine. The mixture was then dried with $Na_2SO_4$ and concentrated. The residue was purified by CombiFlash® using silica gel as the stationary phase with a gradient of EA to Hex 0-100%. 72 mg product was obtained (19% yield).

Synthesis of LP273-p

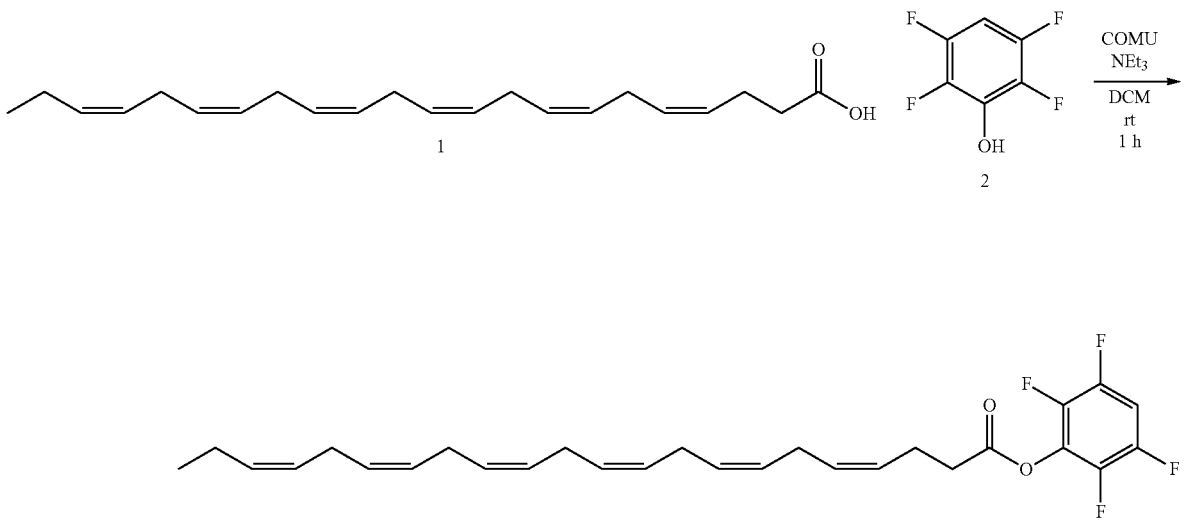

To a solution of compound 1 (0.200 g), NEt₃ (0.255 mL), and COMU (0.261 g) in DCM was added 2 (0.152 g) under ambient conditions. The reaction was stirred until full conversion was observed by LC-MS. The reaction mixture was directly concentrated for isolation. The residue was purified by CombiFlash® via DCM liquid-load onto a 12-g column with a gradient hexanes to 100% EtOAc, in which product eluted at 28% B. The product was concentrated under vacuum to provide a clear and lightly yellow oil. MS m/z: calculated [M+H]+ 477.23 m/z, observed 477.52 m/z.

To a solution of compound 1 (49 mg), NEt₃ (0.068 mL), and COMU (76.8 mg) in DMF was added compound 2 (29.8 mg) under ambient conditions. The reaction was stirred until full conversion was observed by LC-MS. Conversion was not able to be clearly observed by LC-MS, and instead, reaction was allowed to stir for 30 min. until bright yellow color (before the addition of compound 2) transitioned to a honey orange color and all material was observed to be Synthesis of LP274-p

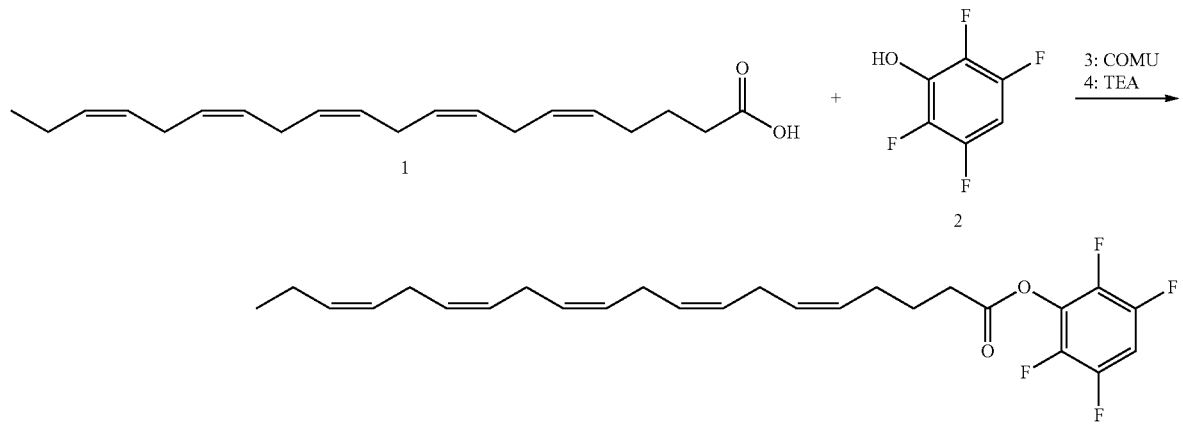

To a solution of EPA 1 (60.5 mg, 0.200 mmol, 1 eqv.) and 2 (36.5 mg, 0.220 mmol, 1.10 eqv.) in 20 mL DCM was added COMU (94.2 mg, 0.220 mmol, 1.10 eqv.) and then TEA (0.084 mL, 0.600 mmol, 3.0 eqv.) under ambient conditions. The reaction was stirred until full conversion was observed by LC-MS. The reaction mixture was washed with 1 N HCl, then brine. The mixture was then dried with Na₂SO₄ and concentrated. The reaction mixture was purified by CombiFlash® using silica gel as the stationary phase with a gradient of EA to Hex 0-50%. 69 mg product was obtained (76% yield).

mainly dissolved. The reaction mixture was washed with water, extracted with DCM, dried over Na₂SO₄, filtered, and concentrated under vacuum. The residue was purified by CombiFlash® via DCM liquid-load onto a 12-g column with a gradient hexanes to 100% EtOAc in which product eluted at 31% B. The product was concentrated under vacuum to provide a white solid residue and confirmed by 1H NMR in CDCl₃.

Synthesis of LP283-p

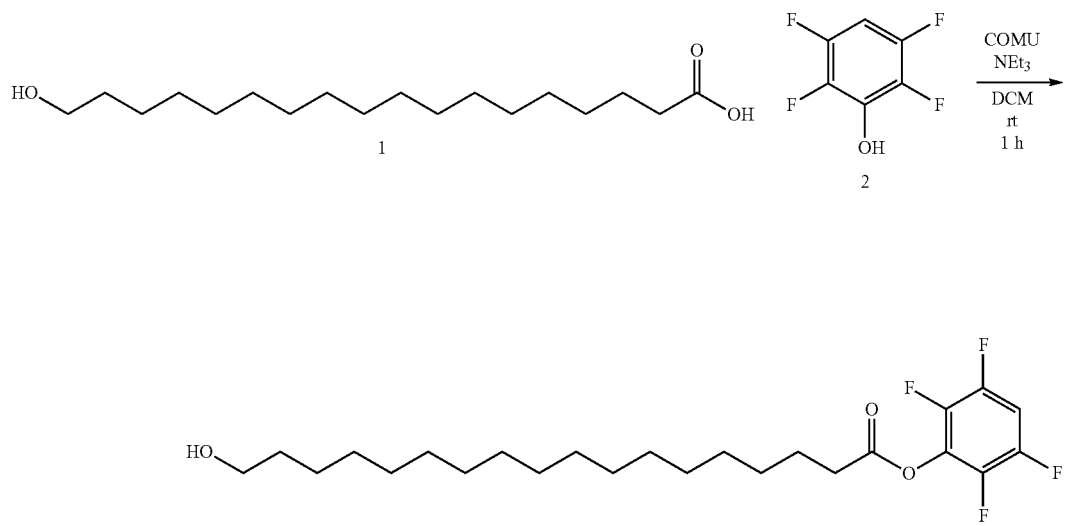

Synthesis of LP286-p

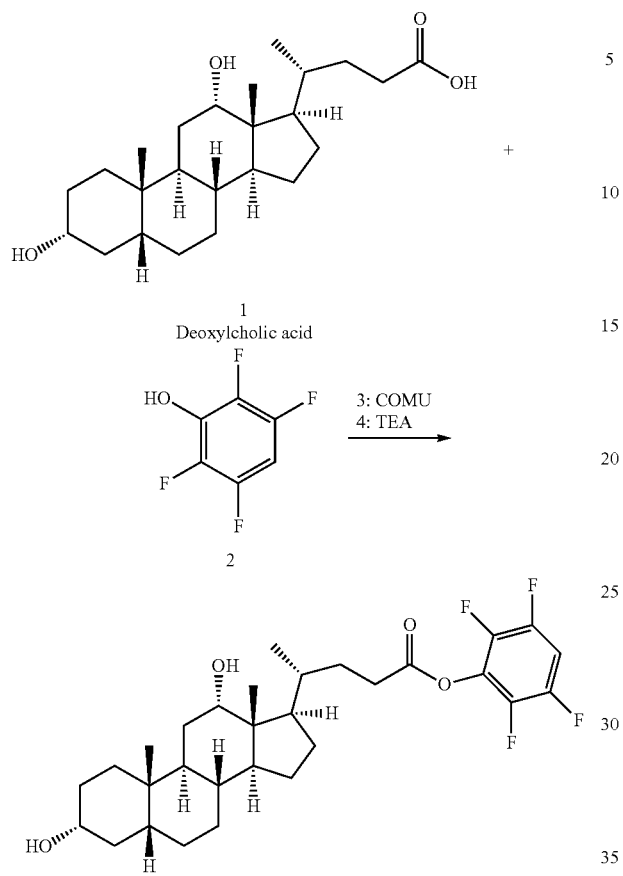

To a solution of 1 (78.5 mg, 0.200 mmol, 1 eqv.) and 2 (36.5 mg, 0.220 mmol, 1.10 eqv.) in 20 mL DCM was added COMU (94.2 mg, 0.220 mmol, 1.10 eqv.) and then TEA (0.084 mL, 0.600 mmol, 3.0 eqv.) under ambient conditions. The reaction was stirred until full conversion was observed by LC-MS. The reaction mixture was washed with 1 N HCl, then brine. The mixture was dried with Na$_2$SO$_4$ and concentrated. The reaction mixture was purified by Combi-Flash® using silica gel as the stationary phase with a gradient of EA to Hex 0-50%. 69 mg product was obtained (57% yield).

Synthesis of LP287-p

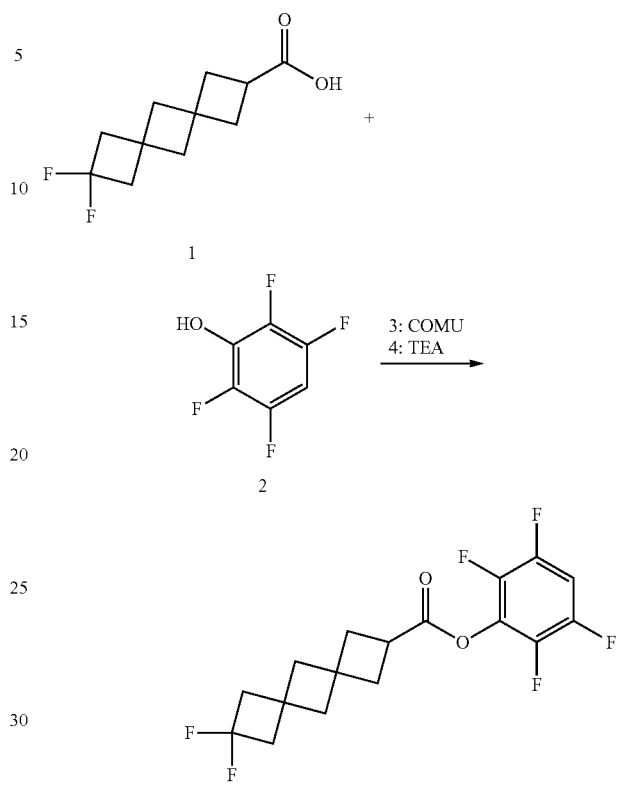

To a solution of 1 (43.3 mg, 0.200 mmol, 1 eqv.) and 2 (36.5 mg, 0.220 mmol, 1.10 eqv.) in 20 mL DCM was added COMU (94.2 mg, 0.220 mmol, 1.10 eqv.) and then TEA (0.084 mL, 0.600 mmol, 3.0 eqv.) under ambient conditions. The reaction was stirred until full conversion was observed by LC-MS. The reaction mixture was washed with 1 N HCl, then brine. The mixture was dried with Na$_2$SO$_4$ and concentrated. The reaction mixture was purified by Combi-Flash® using silica gel as the stationary phase with a gradient of EA to Hex 0-50%. 52 mg product was obtained (71% yield).

Synthesis of LP290-p

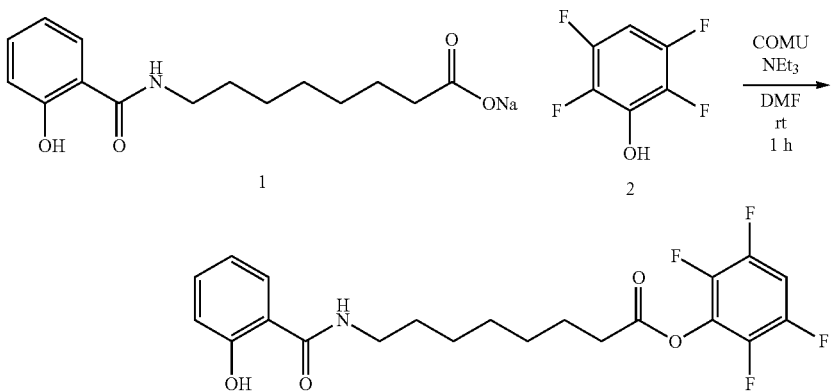

To a solution of compound 1 (0.0540 g), NEt₃ (0.075 mL), and COMU (0.084 g) in DMF was added 2 (0.0327 g) under ambient conditions. The reaction was stirred for 30 min. until bright yellow color (pre-addition of 2) transitioned to a honey orange color and all material was observed to be mostly dissolved. The reaction mixture was washed with water, extracted with DCM, dried over Na₂SO₄, filtered, and concentrated under vacuum. The residue was purified by CombiFlash® via DCM liquid-load onto a 12-g column with a gradient hexanes to 100% EtOAc in which product eluted at 31% B. The product was concentrated under vacuum to provide a white solid residue and confirmed by 1H NMR in CDCl₃. LC-MS: calculated [M+H]+ 428.14 m/z, observed 428.46 m/z.

Synthesis of LP293-p

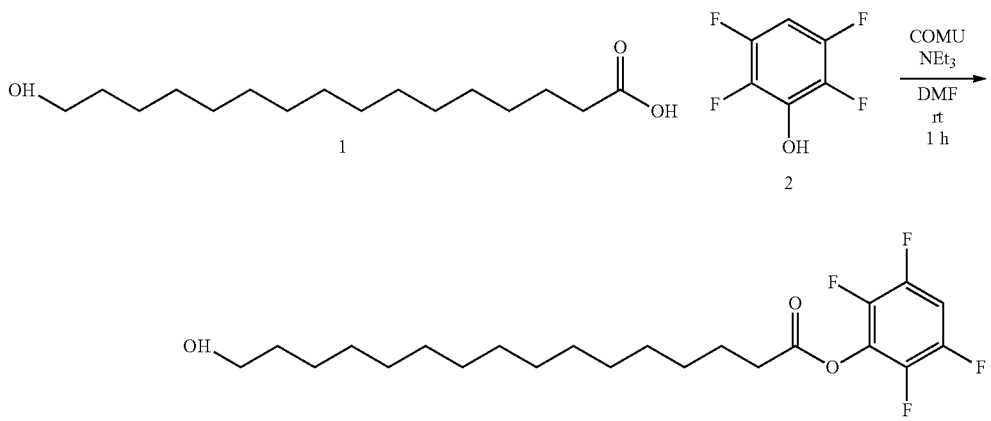

To a solution of compound 1 (73 mg), NEt₃ (0.112 mL), and COMU (126 mg) in DMF was added compound 2 (48.9 mg) under ambient conditions. The reaction was stirred until full conversion was observed by LC-MS. Conversion was not able to be clearly observed by LC-MS, and instead, reaction was allowed to stir for 30 min. until bright yellow color (before the addition of compound 2) transitioned to a honey orange color and all material was observed to be mainly dissolved. The reaction mixture was then washed with water, extracted with DCM, dried over Na₂SO₄, filtered, and concentrated under vacuum. The residue was purified by CombiFlash® via DCM liquid-load onto a 12-g column with a gradient hexanes to 100% EtOAc in which product eluted at 30% B. The product was concentrated under vacuum to provide a white solid residue and confirmed by 1H NMR in CDCl₃.

Synthesis of LP296-p

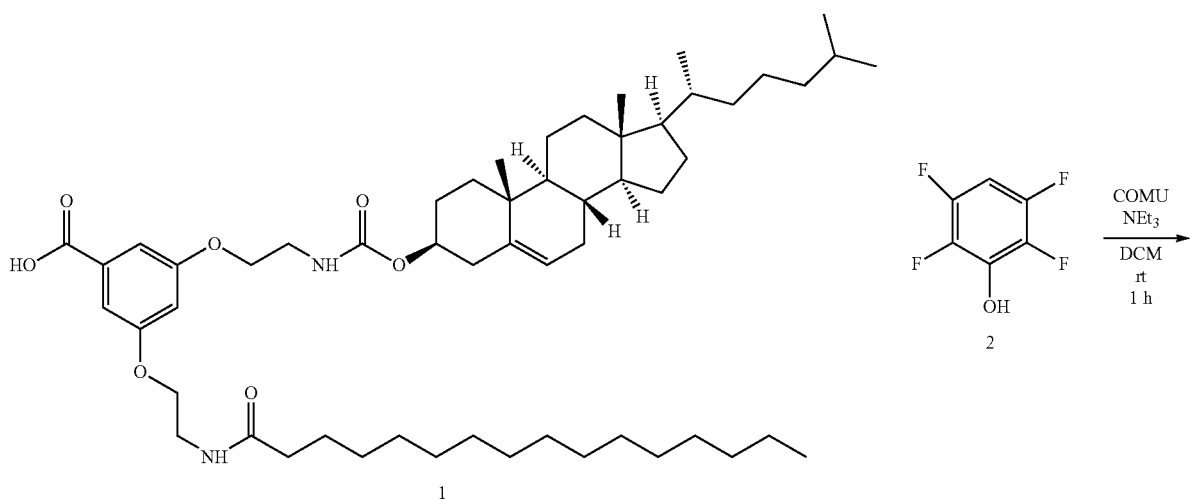

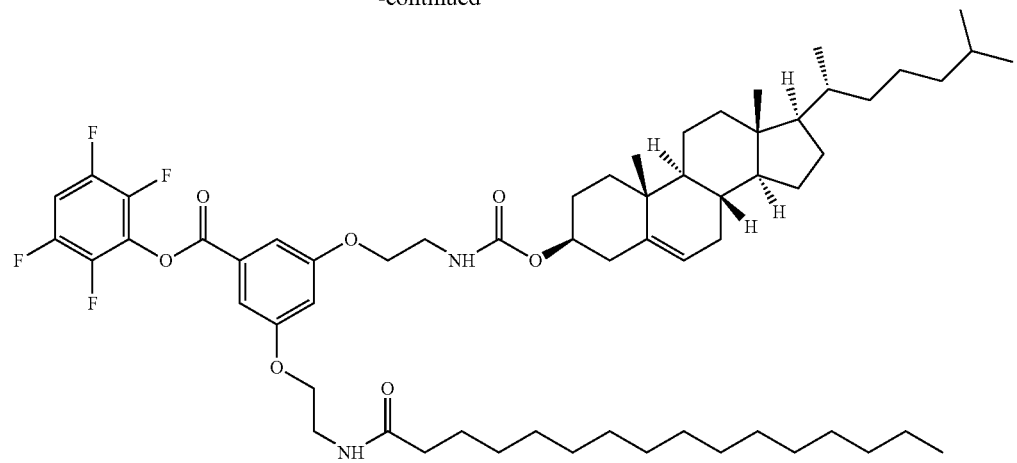

To a solution of compound 1 (0.0344 g), NEt$_3$ (0.0117 g), and COMU (0.0182 g) in DCM was added 2 (0.0071 g) under ambient conditions. The reaction was allowed to stir for 30 min. until bright yellow color (pre-addition of 2) transitioned to a honey orange color and all material was observed to be mainly dissolved. The reaction mixture was directly concentrated for isolation. The residue was purified by CombiFlash® via DCM liquid-load onto a 4-g column with a DCM to 20% MeOH/DCM (0% B to 20% B, to 40% B, to 50% B, then to 100% B), in which product eluted at 23% B. The product was concentrated under vacuum to provide a clear and colorless oil and confirmed by 1H NMR in CDCl$_3$. MS m/z. calculated [M+H]+ 1039.67 m/z; observed 1040.36, 671.78 m/z.

Synthesis of LP300-p

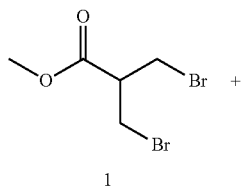

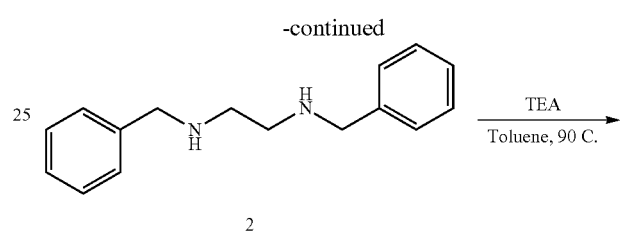

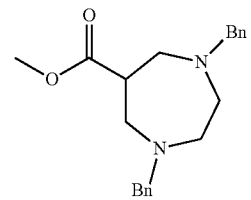

To a solution of 2 (5.29 g) in 100 mL toluene was added TEA (8.4 mL) at room temperature, then 1 (5.20 g) was added dropwise. The reaction mixture was stirred at 90° C. for 16h. After cooling down to room temperature, EtOAc and water were added to workup. Purification was performed on a 120 g column. Hexanes to 30% EtOAc in Hexanes as gradient was used to purify. Product was a light yellow oil, 3658 mg, 54%. LC-MS: calculated [M+H] 339.21, found 339.17.

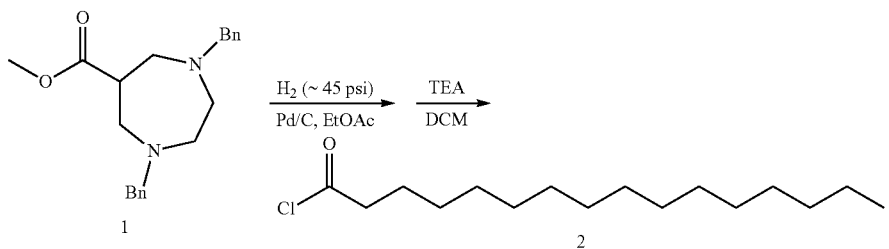

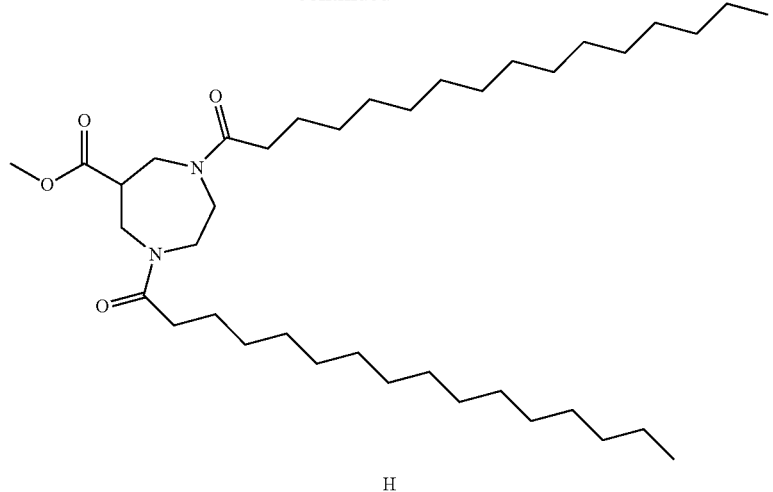

The mixture of 1 (0.113 g) and 10% Pd/C (0.0036 g) in 10 mL EtOAc was charged with H₂ (~45 psi). The reaction mixture was stirred at room temperature for 4h. After filtration, the solvent was removed in vacuo. Then the residue was placed under high vacuum for 1 h. The residue was dissolved in 10 mL DCM, then TEA (0.279 mL) and 2 (0.405 mL) were added at room temperature. The reaction mixture was stirred at room temperature for 1 h. Purification was performed on a 12 g column. Hexanes to 50% EtOAc in Hexanes as gradient was used to purify. Product was a white solid, 141 mg, 66%. LC-MS: calculated [M+H] 635.57, found 635.95.

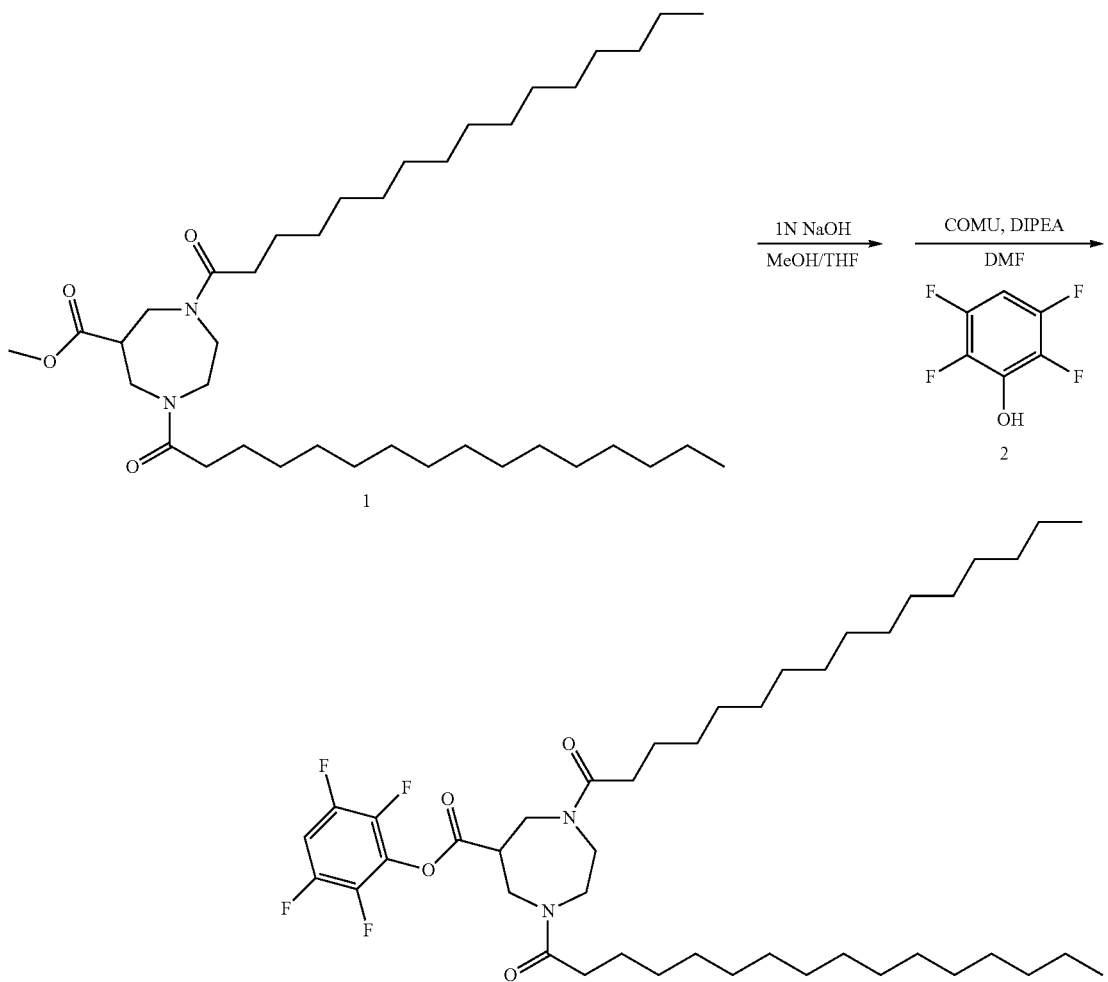

The solution of 1 (0.141 g) in MeOH/THF (3 mL/3 mL) was added 1 N NaOH (3 mL) at room temperature. The mixture was stirred at room temperature for 2h. After removing organic solvent in vacuo, the residue was acidified with conc. HCl to pH ~1. EtOAc was added to extract the product. After removing solvent in vacuo, the residue was placed under high vacuum for 3h. The residue was dissolved in DMF/DCM (5 mL/5 mL), then DIPEA (0.077 mL), COMU (0.143 g) and 2 (0.074 g) were added. The mixture was stirred at room temperature for 2h. The reaction mixture was diluted with EtOAc, then was washed with 1 N HCl and Brine. After removing solvent in vacuo, the residue was loaded on a 12 g column. Hexanes to 30% EtOAc in Hexanes as gradient was used to purify. Product was a white solid, 80 mg, 47%. LC-MS: calculated [M+H] 769.55, found 769.98.

Synthesis of LP303-p

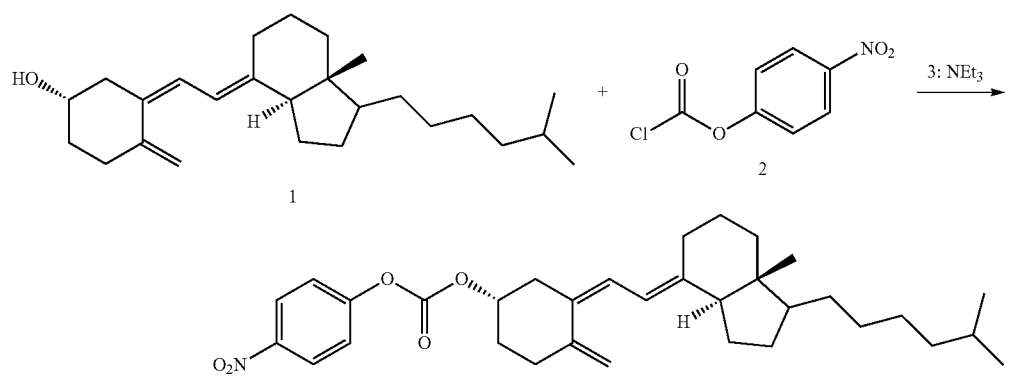

To a solution of Vitamin D 1 (185 mg, 0.500 mmol, 1 eqv.) and 2 (111 mg, 0.550 mmol, 1.10 eqv.) in 30 mL DCM was added TEA (0.139 mL, 1.00 mmol, 2.0 eqv.) under ambient conditions. The reaction was stirred at r.t for 8 hours. The reaction mixture was washed with 1 N HCl, then brine. The mixture was dried with Na₂SO₄ and concentrated. The residue was purified by CombiFlash® using silica gel as the stationary phase with a gradient of EA to Hex 0-100%. 95 mg product was obtained (35% yield).

Synthesis of LP304-p

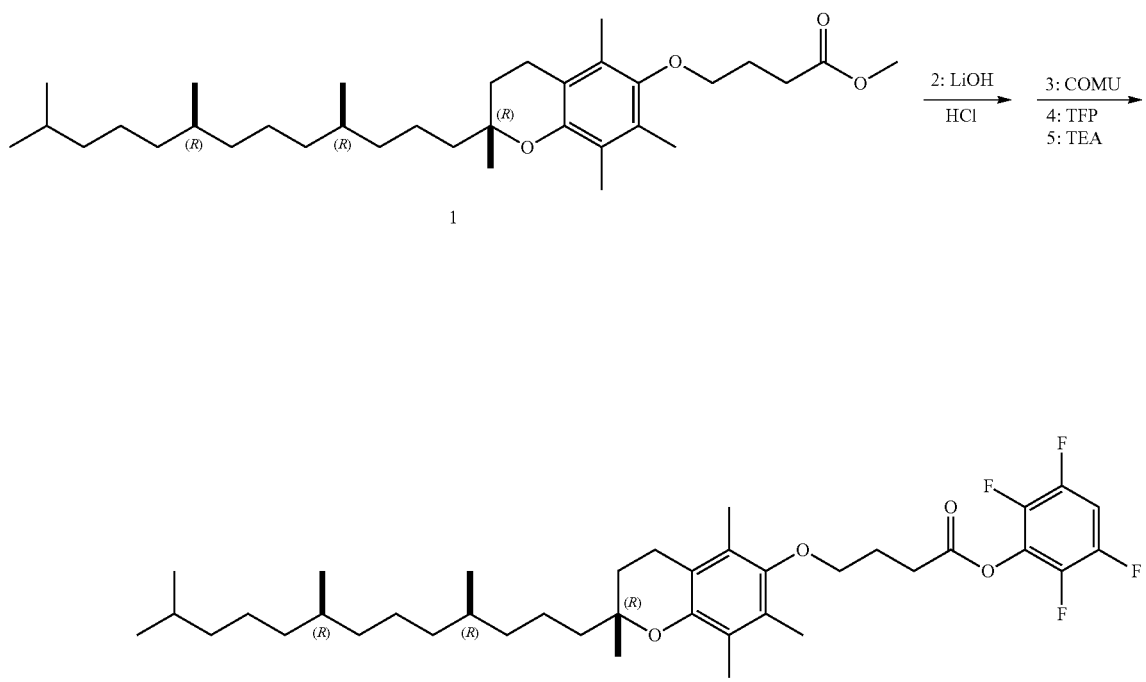

1 (200 mg, 0.377 mmol, 1.0 eqv.) was hydrolyzed with LiOH (151 mg, 3.77 mmol, 10.0 eqv.) in MeOH/TFH/H$_2$O (1:1:1, 90 mL). After removing all organic solvent, the aqueous phase was acidified to pH=3 with 1 N HCl. The reaction mixture extracted with ethyl acetate (100 mL×3). The organic phases were combined, dried with Na$_2$SO$_4$ and concentrated to get crude acid.

To a solution of above crude acid and tetrafluorophenol 4 (68.9 mg, 0.415 mmol, 1.10 eqv.) in 30 mL DCM was added COMU (194 mg, 0.453 mmol, 1.20 eqv.) and then TEA (0.158 mL, 1.13 mmol, 3.0 eqv.) under ambient conditions. The reaction was stirred until full conversion was observed by LC-MS. The reaction mixture was washed with 1 N HCl, then brine. Dry with Na$_2$SO$_4$ and concentrated. The reaction mixture was purified by CombiFlash® using silica gel as the stationary phase with a gradient of EA to Hex 0-100%. 170 mg product was obtained (85% yield).

with brine. After removing the solvent, the residue was loaded on a 4 g column. Hexanes to 50% Hexanes in EtOAc as gradient was used to purify. Product was a white solid, 46 mg, 44%. LC-MS: calculated [M+H] 422.36, found 422.61.

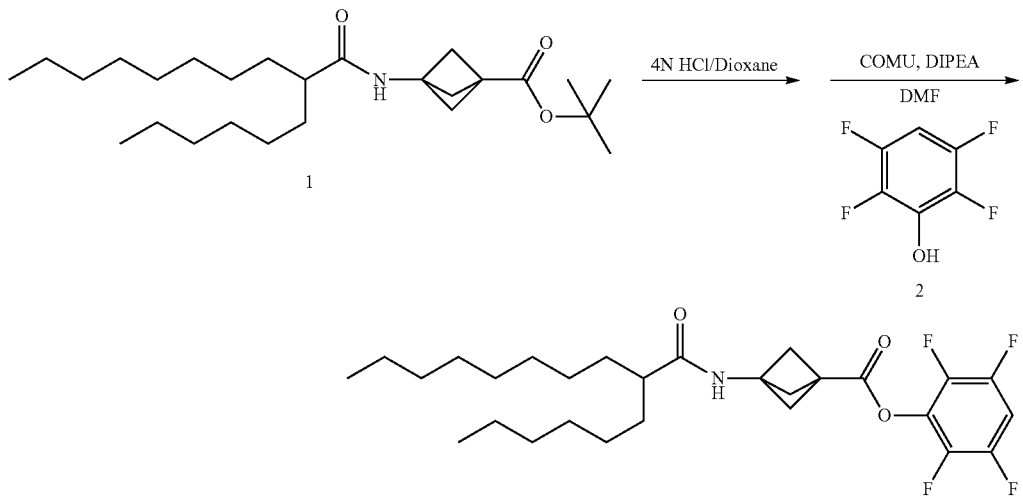

The solution of 1 (0.046 g) in 4N HCl/Dioxane (2 mL) was stirred at room temperature overnight. After removing the solvent in vacuo, the residue was placed under high vacuum for 3h. Then the residue was dissolved in DCM at room temperature, then COMU (0.0700 g), DIPEA (0.038 mL) and 2 (0.036 g) were added at room temperature. After stirring at room temperature for 2h, the solvent was removed in vacuo. The residue was loaded on a 4 g column. Hexanes to 50% Hexanes in EtOAc as gradient was used to purify. Product was a white solid, 21 mg, 38%. LC-MS: calculated [M+H] 514.29, found 514.61.

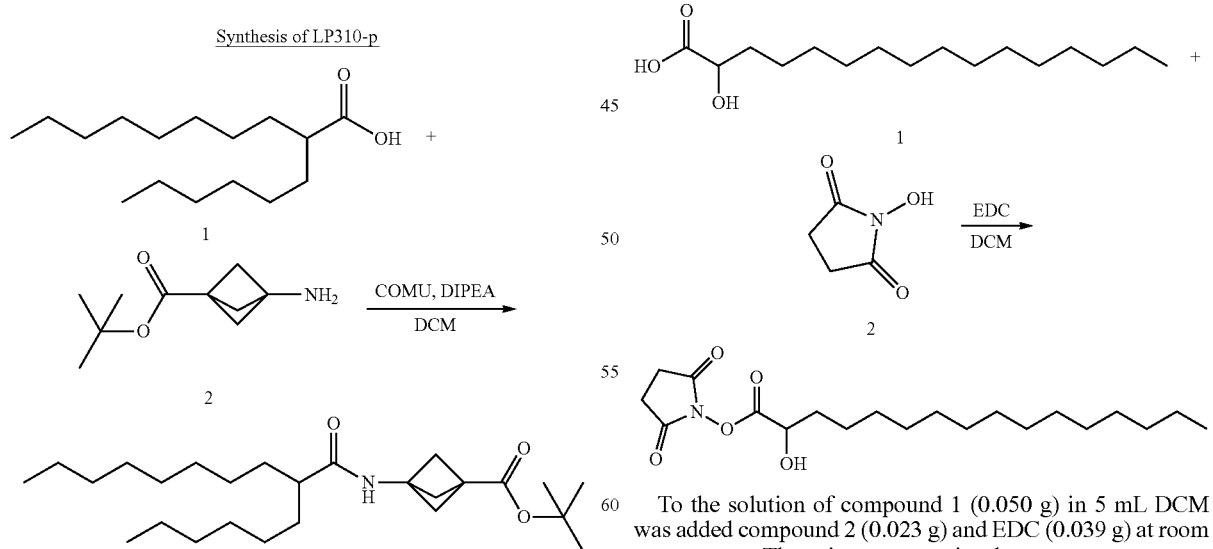

Synthesis of LP310-p

Synthesis of LP383-p

To the solution of 1 in DCM was added DIPEA (0.057 mL), COMU (0.077 g) and 2 (0.0300 g) at room temperature. After stirring at room temperature for 2h, the reaction was quenched with 0.1N HCl. The organic layer was washed To the solution of compound 1 (0.050 g) in 5 mL DCM was added compound 2 (0.023 g) and EDC (0.039 g) at room temperature. The mixture was stirred at room temperature for 1 h. After removing the solvent in vacuo, the residue was loaded on a 4 g column by dry method. Hexanes to 50% EtOAc in Hexanes was used to purify the product. Pdt is a white solid, yield, 29 mg. LC-MS: calculated [M+H+H$_2$O] 388.27, found 388.03.

Synthesis of LP409-p

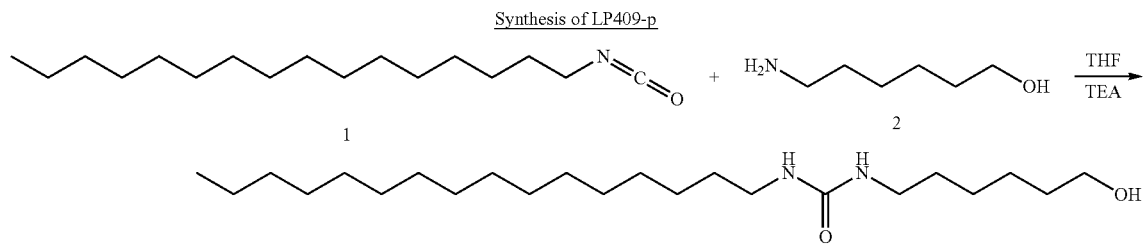

Compounds 1 (1.40 g) and 2 (0.613 g) were dissolved in 100 mL THF, then TEA (2.01 mL) was added. The reaction was stirred at 60° C. until full conversion was confirmed via LC-MS (2-3 hours). The reaction was cooled down to room temperature. Product obtained as whilte precipitate, which was filtered and washed with Acetone (20 mL). Compound structure was verified using $^1$H and $^{13}$P NMR.

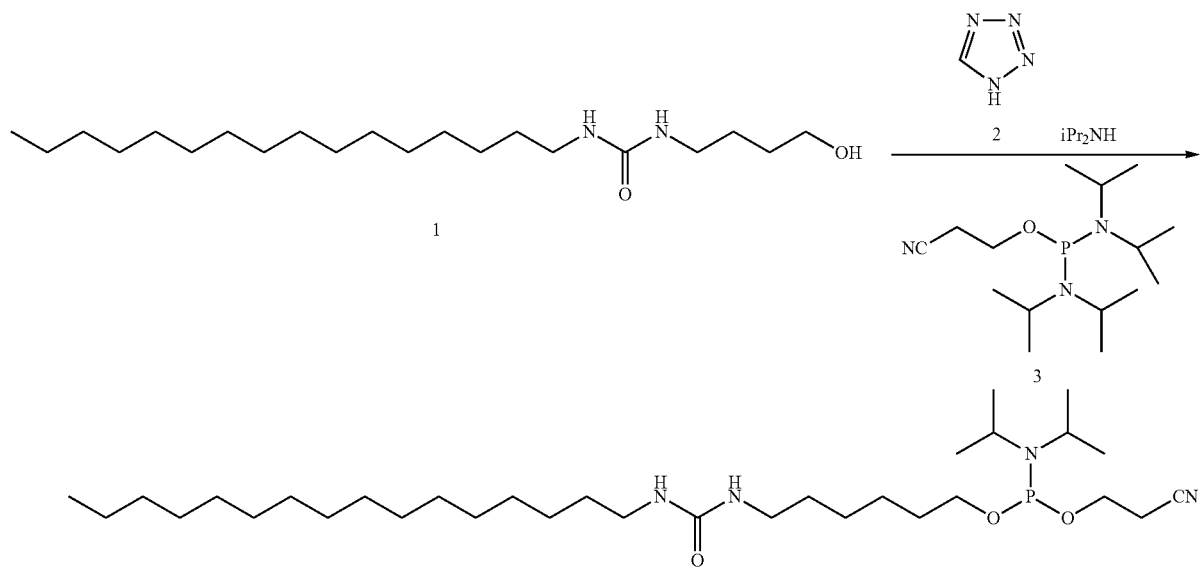

Compounds 1 (1.9 g), 2 (0.846 g) and 3 (2.98 g) were dissolved in 100 mL DCM then heated to 40° C. The reaction was stirred until the solution became clear. The reaction was cooled down to room temperature and stirred overnight. After removing all DCM, the product was dry loaded onto a 24 g column. Product was obtained as a white solid using 0-50% (EA/Hex, 1% TEA added) as mobile phase.

Synthesis of LP429-p

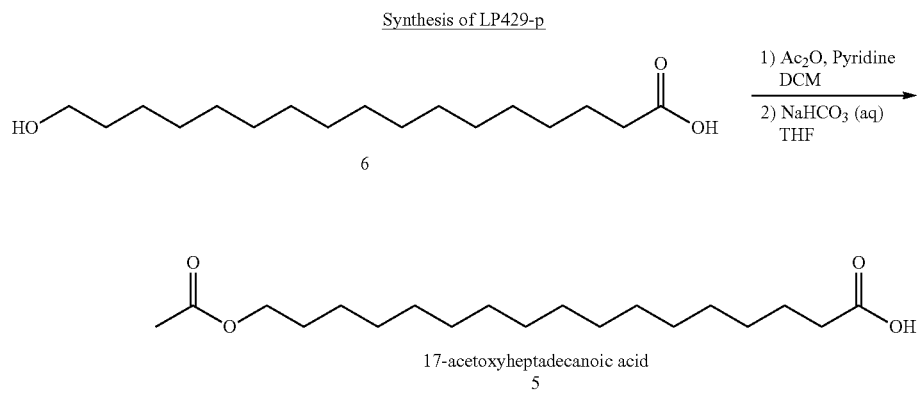

17-acetoxyheptadecanoic acid
5

17-hydroxyhexadecanoic acid (6) (3.53 g, 12.3 mmol) was added to a 500 mL RBF. The flask was purged with nitrogen, then DCM (150 mL) was added followed by acetic anhydride (18.6 mL, 197 mmol) and pyridine (30.8 mL, 382 mmol). The reaction was stirred overnight. The reaction mixture was concentrated and azeotroped 3 times with toluene to remove residual pyridine, acetic acid, acetic anhydride. The residue was then stirred in 100 mL of a 1:1 THF/aq. NaHCO$_3$ mixture for 24 hours. About half of the THF was removed via rotary evaporator and the mixture was diluted with water and acidified with 3 M HCl until a pH of 1. The mixture became very foamy during the acidification. The product was collected by filtration and dried in vacuo to yield 3.22 g (80% yield) of compound 5 as a white solid. The product was not purified further.

mL). The layers were separated and the aqueous layer was extracted with EtOAc (2×50 mL), the combined organic layers were washed with water (50 mL), brine (50 mL), dried over sodium sulfate and concentrated to a white solid. Proton NMR showed no remaining starting material based on protons alpha to the carbonyl. The solid was dissolved in toluene (55 mL) and heated to 65° C. until gas evolution stopped (about 30 minutes). The reaction was cooled to room temperature and N-hydroxy succinimide (1.22 g, 10.5 mmol) was added followed by pyridine (0.85 mL, 10.5 mmol). Proton NMR indicated not all the isocyanate was consumed after 2 hours, additional 2 eq of N-hydroxy succinimide (2.43 g, 21.1 mmol) was added. The reaction was stirred overnight. No isocyanate remained by proton NMR after stirring overnight. The reaction mixture was

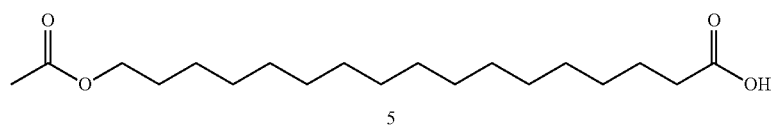

5

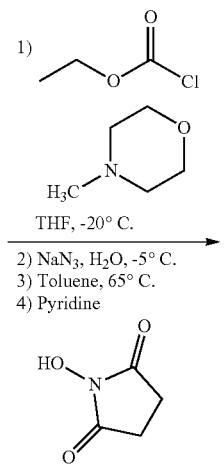

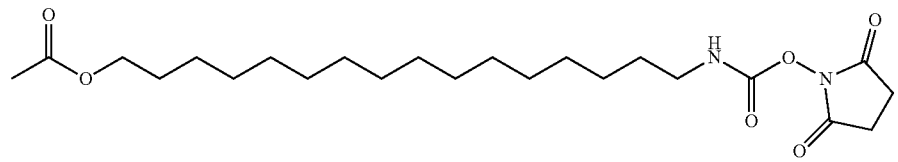

7

Compound 5 (3.47 g, 10.6 mmol) was dissolved in THF (55 mL) and cooled to −15 to −20° C. in a methanol/ice bath. Once cooled, N-methyl morpholine (1.4 mL, 12.7 mmol) and ethyl chloroformate (1.2 mL, 12.7 mmol) were added. The reaction was stirred at −15 for 30 minutes. After 30 minutes a solution of sodium azide (1.72 grams, 26.4 mmol) in water (6.6 mL) was added and the reaction was stirred for 30 minutes at −5°-0° C. in a water/salt/ice bath. The reaction mixture was diluted with EtOAc (20 mL) and water (20 concentrated, the resulting white powder was dissolved in EtOAc (100 mL) and poured into 300 mL hexanes. The percipitate was collected by filtration. Proton NMR of the product showed residual N-hydroxy succinimide. The product was dissolved in DCM and purified by silica gel chromatography 65:35 Hexanes:EtOAc to 0:100 Hexanes:EtOAc. Product began eluting at 50% EtOAc and dragged on the column. Fractions containing product were combined to yield 2.25 g (48% yield) of compound 7 as a white solid.

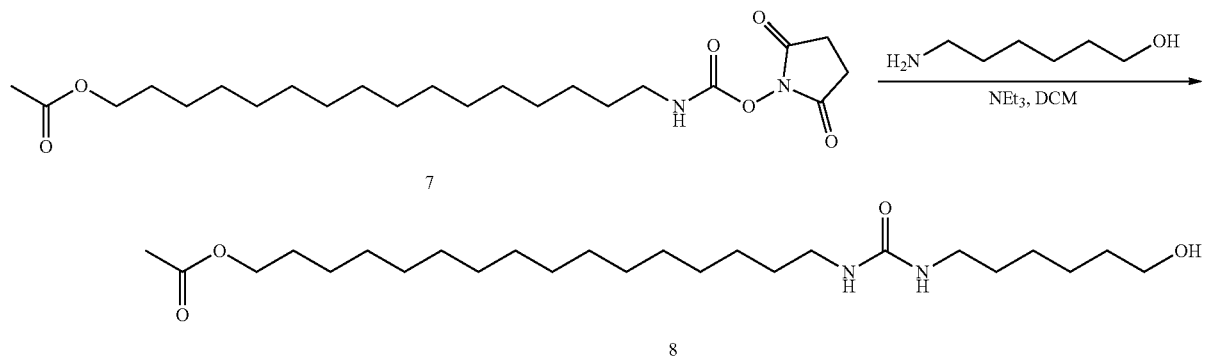

Compound 7 (1.00 g, 2.27 mmol) was added to a solution of 6-amino-1-hexanol (0.266 g, 2.27 mmol) and NEt₃ (0.95 mL, 6.81 mmol) in DCM (50 mL). A white ppt formed. No SM remained by LC-MS after 18 hours. The reaction was concentrated by rotary evaporator, te residue was dissolved in about 8 mL of ethyl acetate and was cool to −20° C. in a freezer. A precipitate formed and settled at the bottom of the flask. The EtOAc was decanted off twice and the precipitate was collected and dried under vacuum to yield 0.95 grams (94% yield) of compound 8 as a white powder.

was purged and backfilled with nitrogen 3 times, and the solids were dissolved in DCM (50 mL). The mixture was stirred for 30 minutes. After 30 minutes 2-cyanoethyl N,N,N',N'-tetraisopropylphosphorodiamidite (0.98 g, 3.25 mmol) was added and the reaction was stirred for 18 hours. After 18 hours, LC-MS indicated no starting alcohol remained. The reaction was transferred to a separatory funnel, washed with sat. aq. NaHCO₃ (2×40 mL), water (40 mL), brine (40 mL), dried over magnesium sulfate and concentrated to dryness. Hexanes was added to the flask and the residue was stirred

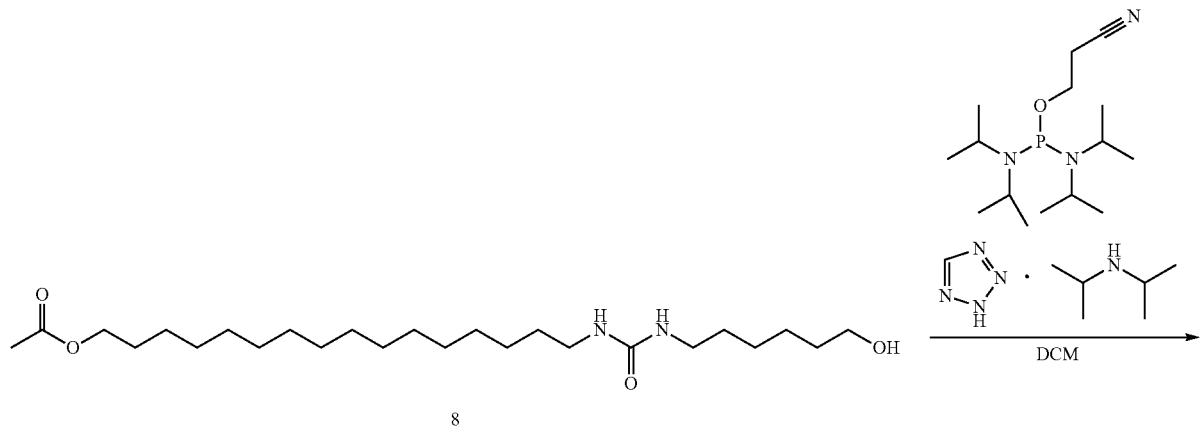

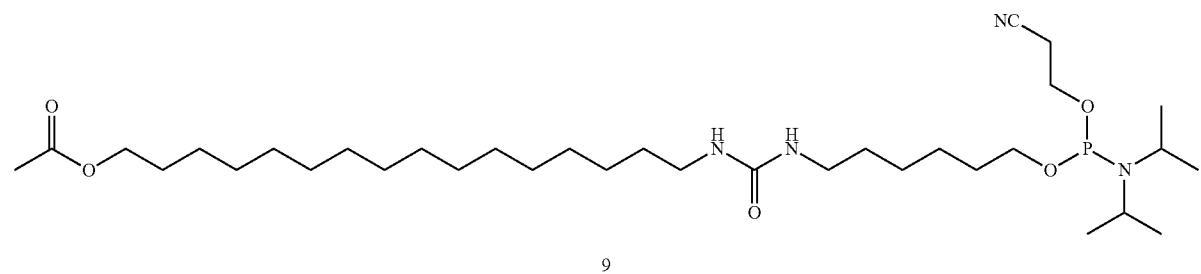

In a 100 mL RBF compound 8 (0.95 g, 2.14 mmol) was dried by 3 successive evaporations of toluene. Diisopropylammonium tetrazolide (0.146 g, 0.86 mmol) and 4 angstrom molecular sieves were added to the flask. The flask in hexanes for 2 hours to yield a white precipitate. The white solid was collected by filtration, washed with hexanes (2×20 mL), and dried under vacuum to yield 1.2 grams (87% yield) of compound 9 as a white solid.

Synthesis of LP430-p

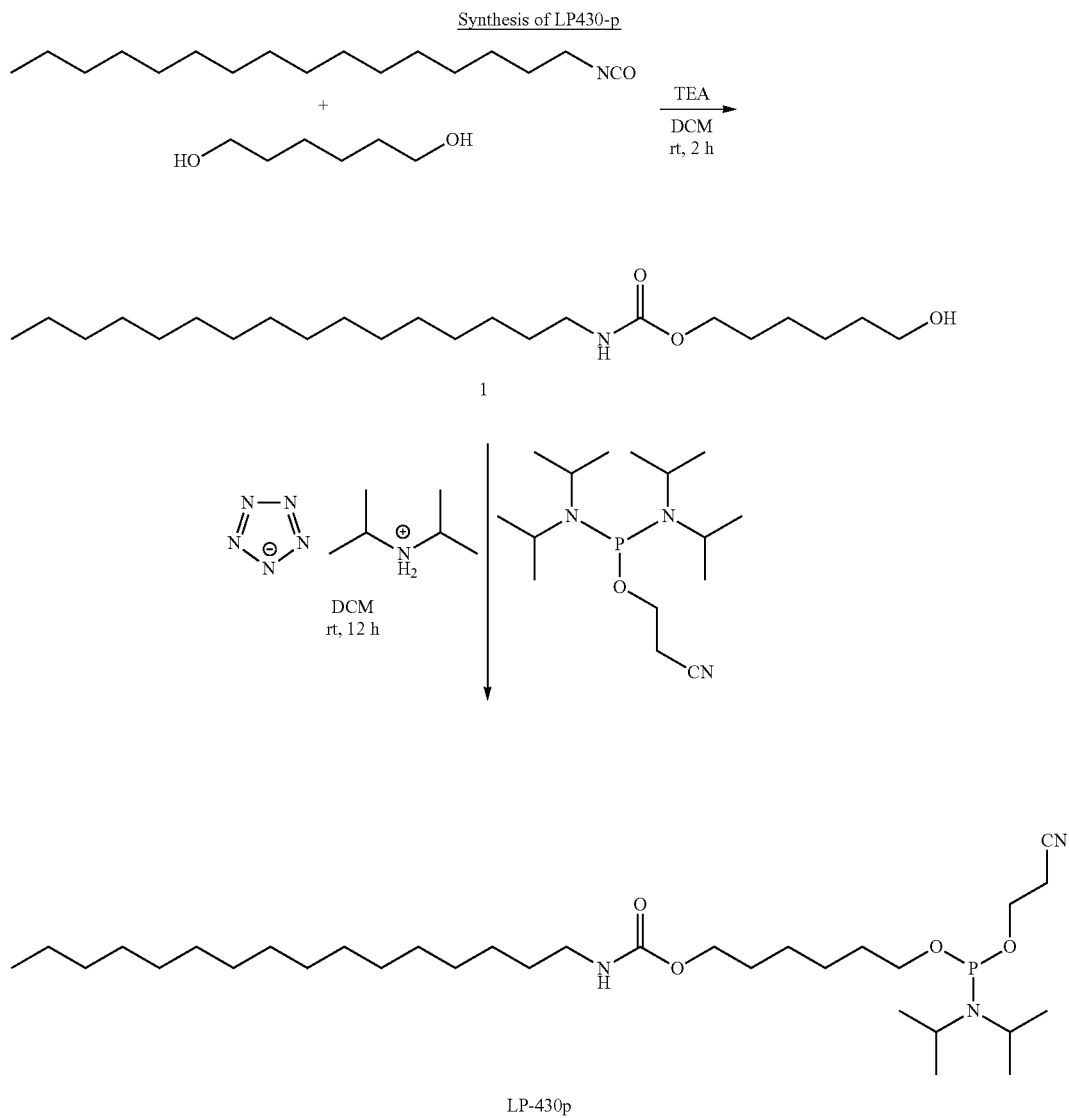

LP-430p

To a round bottom flask with hexadecyl isocyanate (1 eq) in DCM (5 mL) was added a solution of 1,6-hexanediol (1 eq) and TEA (2 eq) in DCM (5 mL). This mixture was stirred at room temperature for 2 hours. Then, the mixture was concentrated under reduced pressure and purified via CombiFlash chromatography using 2% MeOH in DCM to give compound 1 as an off-white solid in 20% yield. LC-MS [M+H]$^+$ 386.3634 m/z, observed 386.3642 m/z.

Compound 1 (1 eq) was dried by two evaporations of toluene. Then, it was dissolved in anhydrous DCM (10 mL) and diisopropylammonium tetrazolide (1.4 eq) was added followed by activated molecular sieves (100 mg). The mixture was stirred under N2 gas at room temperature for 30 minutes. Then, 2-cyanoethyl N,N,N',N'-tetraisopropylphosphorodiamidite (1.6 eq) was added and stirring was continued at room temperature for 12 hours. After, 0.3 mL of TEA was added to quench the reaction and the mixture was directly loaded onto celite. CombiFlash chromatography using hexanes: ethyl acetate+1% TEA (70:30) to give pure product as a waxy, off-white solid in 41.7% yield. LC-MS [M+H]$^+$ 586.4713 m/z, observed 586.4720 m/z.

Synthesis of LP431-p

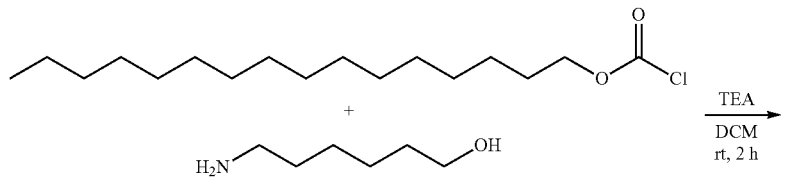

-continued

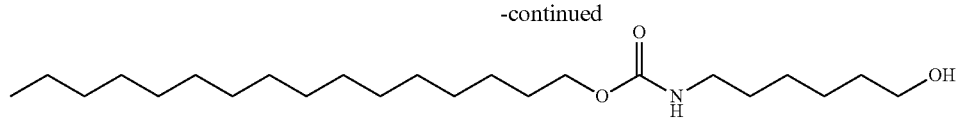

1

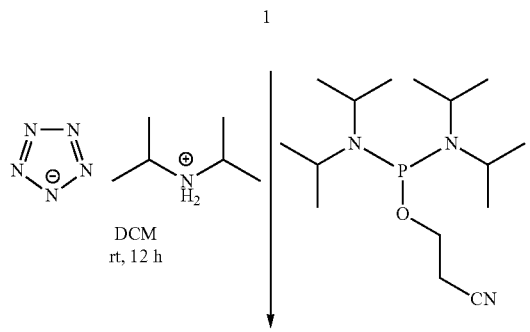

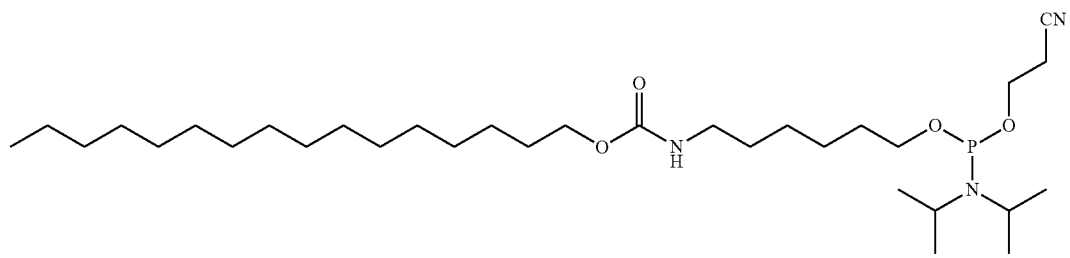

LP-431p

To a round bottom flask containing 6-amino-1-hexanol (1.2 eq) and TEA (2 eq) in DCM (5 mL) was added a solution of hexadecyl chloroformate (1 eq) in DCM (5 mL). The reaction mixture was stirred at room temperature for 2 hours. Then, the mixture was concentrated under reduced pressure and purified via CombiFlash chromatography using 2% MeOH in DCM to give compound 1 as an off-white solid in 20% yield. LC-MS [M+H]$^+$ 386.3634 m/z, observed 386.3638 m/z.

Compound 1 (1 eq) was dried by two evaporations of toluene. Then, it was dissolved in anhydrous DCM (10 mL) and diisopropylammonium tetrazolide (1.4 eq) was added followed by activated molecular sieves (100 mg). The mixture was stirred under N2 gas at room temperature for 30 minutes. Then, 2-cyanoethyl N,N,N',N'-tetraisopropylphosphorodiamidite (1.6 eq) was added and stirring was continued at room temperature for 12 hours. After, 0.3 mL of TEA was added to quench the reaction and the mixture was directly loaded onto celite. CombiFlash chromatography using hexanes: ethyl acetate+1% TEA (70:30) to give pure product as a waxy, off-white solid in 82.3% yield. LC-MS [M+H]$^+$ 586.4713 m/z, observed 586.4705 m/z.

Synthesis of LP435-p

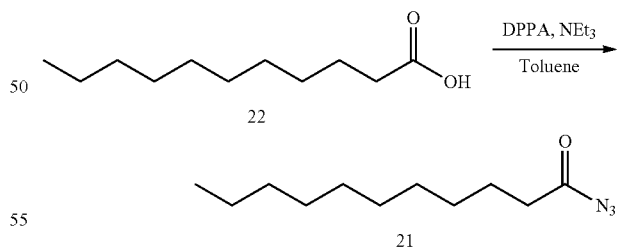

Undecanoic acid (2.0 g, 10.7 mmol) was dissolved in toluene (30 mL) and triethylamine (3.0 mL, 21.5 mmol) and diphenylphosphoryl azide (3.84 g, 14.0 mmol) were added. The reaction was stirred overnight. The acyl azide was observed by mass spec under basic conditions. The mixture was concentrated and the crude product was purified buy silica gel chromatography (0:100 EtOAc:Hexanes to 20:80 EtOAc:Hexanes) The product eluted at 10% EtOAc. Fractions containing product were concentrated to yield 0.975 g (43% yield) of compound 21 as a clear liquid.

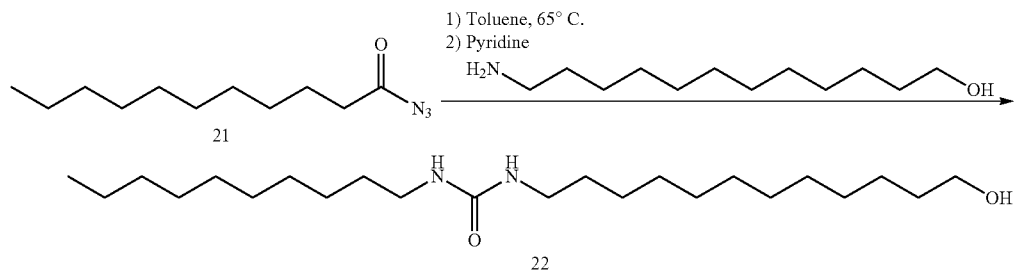

Compound 21 (0.975, 5.2 mmol) was dissolved in toluene (40 mL) and heated to 65° C. for 1 hour. Gas evolution was observed upon reaching 65° C. and stopped after approx. 30 min. The reaction mixture was cooled to room temperature. In a separate flask 1-amino-12-dodecanol (1.05 g, 5.2 mmol) was dissolved in THF (20 mL) and pyridine (0.85 mL, 10.5 mmol). The toluene solution was added to the THF solution and a white ppt rapidly formed. The reaction was stirred overnight. The reaction mixture was concentrated, and the crude product was recrystallized from isopropanol to yield 1.5558 g (77% yield) of compound 22 as a white solid.

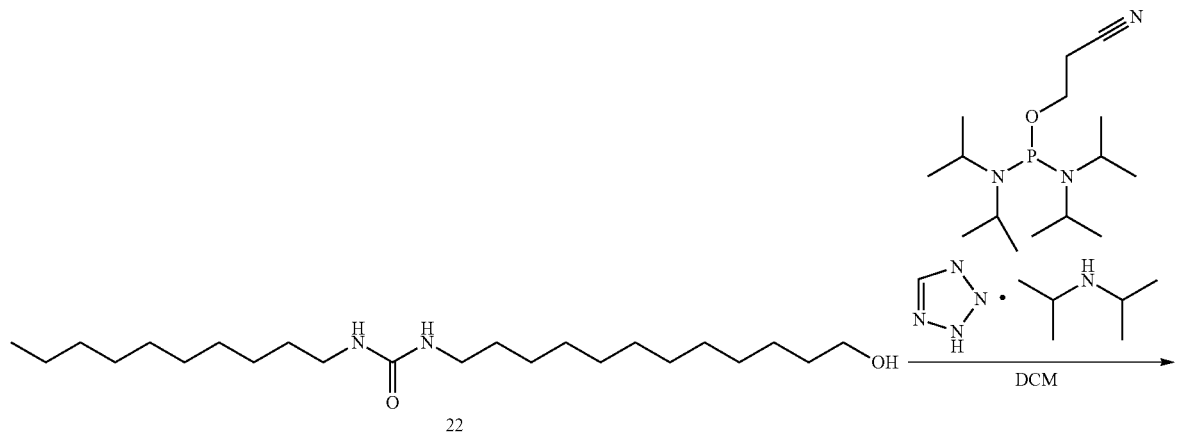

In a 100 mL RBF compound 22 (1.55 g, 4.0 mmol) was dried by 2 successive evaporations of toluene. Diisopropylammonium tetrazolide (0.277 g, 1.6 mmol) and 4 angstrom molecular sieves were added to the flask. The flask was purged and backfilled with nitrogen 3 times, and the solids were suspended in DCM (20 mL). The solids only partially dissolved. To the mixture 2-cyanoethyl N,N,N',N'-tetraisopropylphosphorodiamidite (1.88 g, 6.2 mmol) was added and the reaction was stirred for 18 hours. LC-MS indicated no starting alcohol remained The reaction was transferred to a separatory funnel, washed with sat. aq. NaHCO$_3$ (2×40 mL), water (40 mL), brine (40 mL), dried over sodium sulfate and concentrated to dryness. Hexanes was added to the flask and the residue was stirred in hexanes for 1 hour to yield a white precipitate. The white solid was collected by filtration, washed with hexanes (2×20 mL), and dried under vacuum to yield 1.103 grams of a white powder. Proton NMR indicated a large amount of water remained, and a significant amount of the material was insoluble chloroform and DCM. The mixture was suspended in DCM, dried over magnesium sulfate, filtered through an additional pad of magnesium sulfate, and concentrated to yield 0.46 g (19% yield) of compound LP435-p as an off-white powder.

Synthesis of LP439-p

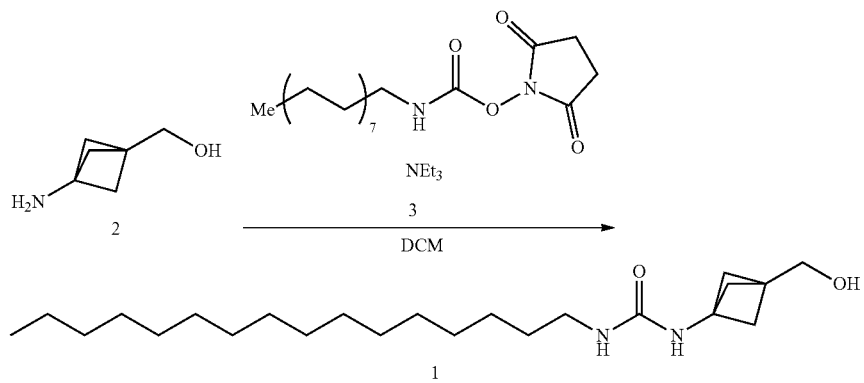

(3-aminobicyclo[1.1.1]pentan-1-yl)methanol (2) (0.20 g, 1.77 mmol) and 2,5-dioxopyrrolidin-1-yl hexadecylcarbamate (3) (0.67 g, 1.75 mmol) were dissolved in DCM (40 mL) followed by the addition of triethylamine (0.72 mL, 5.3 mmol). The reaction was stirred overnight. After 18 hours a precipitate was observed. The precipitate was collected by filtration and washed with DCM (2×10 mL). The precipitate was dried in vacuo to yield 0.325 g (48% yield) of a white solid. Proton NMR analysis was consistent with product and crude material was of acceptable purity to proceed to the next step.

the flask. The flask was purged and backfilled with nitrogen 3 times, the solids were suspended in DCM (20 mL) and 2-cyanoethyl N,N,N',N'-tetraisopropylphosphorodiamidite (0.39 mL, 1.214 mmol) was added and the reaction was stirred for 18 hours. LC-MS analysis indicated no starting alcohol remained after 18 hours. The reaction was transferred to a separatory funnel, washed with sat. aq. NaHCO$_3$ (2×40 mL), water (40 mL), and concentrated to dryness. Hexanes was added to the residue, and the mixture was stirred for 1 hour to yield a white precipitate. The precipitate

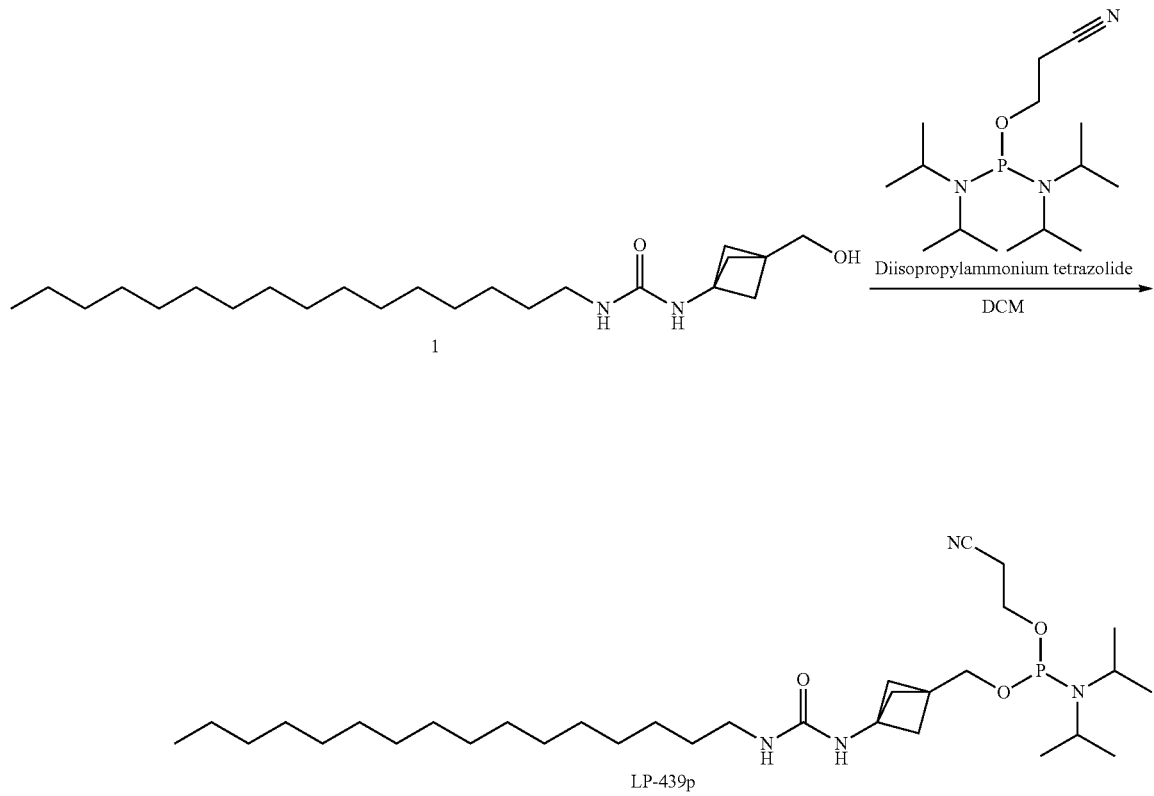

Compound 1 (0.3 grams, 0.79 mmol) was dried by 4 successive evaporations with toluene then diisopropyl ammonium tetrazolide (0.054 g, 0.315 mmol) was added to was collected by filtration, washed with hexanes, and dried under vacuum to yield 0.395 g (86% yield) of LP439-p as a white solid.

Synthesis of LP440-p

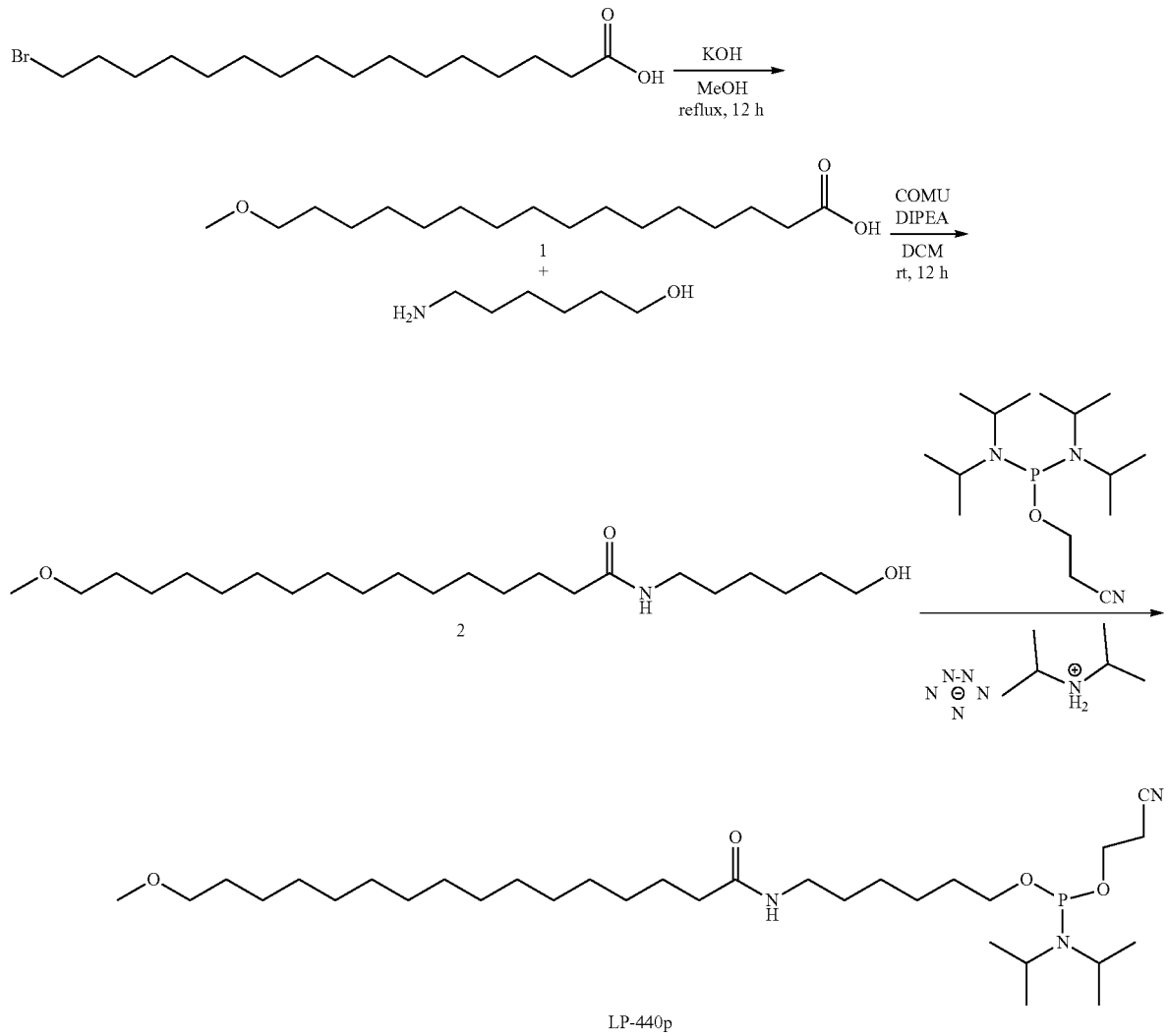

LP-440p

Anhydrous MeOH (8 mL) was cooled to 0° C., potassium hydroxide (3 eq) added, and the solution stirred for 30 min. A solution of 16-Bromohexadecanoic acid (1 eq) in anhydrous MeOH (7 mL) was then added via syringe. The reaction mixture was heated to reflux temperatures and stirred overnight. After cooling to room temperature, MeOH was removed in vacuo and the resulting crude mixture reconstituted in 1 N HCl (25 mL) and diethyl ether (5 mL). The crude product was extracted using diethyl ether (4×30 mL), the combined organic layers were washed with brine (30 mL) and dried over $Na_2SO_4$, and then the solvent removed in vacuo. Product was then purified on silica gel via column chromatography using hexanes: ethyl acetate (85:15) to give compound 1 as an oil in 86% yield. LC-MS [M+H]⁺ 287.2586 m/z, observed 287.2590.

To a solution of compound 1 (1 eq) in DCM (50 mL) was added COMU (1.2 eq) and DIPEA (2 eq). This mixture was stirred at room temperature for 30 minutes. Then, 6-amino-1-hexanol (1.2 eq) was added and the reaction mixture was stirred at room temperature for 12 hours. Then, the mixture was washed thrice with 1 M HCl (3×50 mL), once with brine (50 mL), dried over $Na_2SO_4$, and concentrated under reduced pressure. To the crude product was added ACN (100 mL) and carefully heated using the heatgun until all solids were soluble. This mixture was then left at room temperature which gave white crystals to form. The precipitate was then collected via vacuum filtration and washed several times with ACN to get rid of residual pink color. Compound 2 was obtained as white solid in 74% yield. LC-MS [M+H]⁺ 386.3634 m/z, observed 386.3626.

Compound 3 (1 eq) was dried by two evaporations of toluene. Then, it was dissolved in anhydrous DCM (10 mL) and diisopropylammonium tetrazolide (0.4 eq) was added followed by activated molecular sieves (100 mg). The mixture was stirred under N2 gas at room temperature for 30 minutes. Then, 2-cyanoethyl N,N,N',N'-tetraisopropylphosphorodiamidite (1.5 eq) was added and stirring was continued at room temperature for 12 hours. After, 0.3 mL of TEA was added to quench the reaction and the mixture was directly loaded onto celite. CombiFlash chromatography using hexanes: ethyl acetate+1% TEA (70:30) to give pure product as a waxy, off-white solid in 86% yield. LC-MS [M+H]⁺ 586.4713 m/z, observed 586.4705.

Synthesis of LP441-p

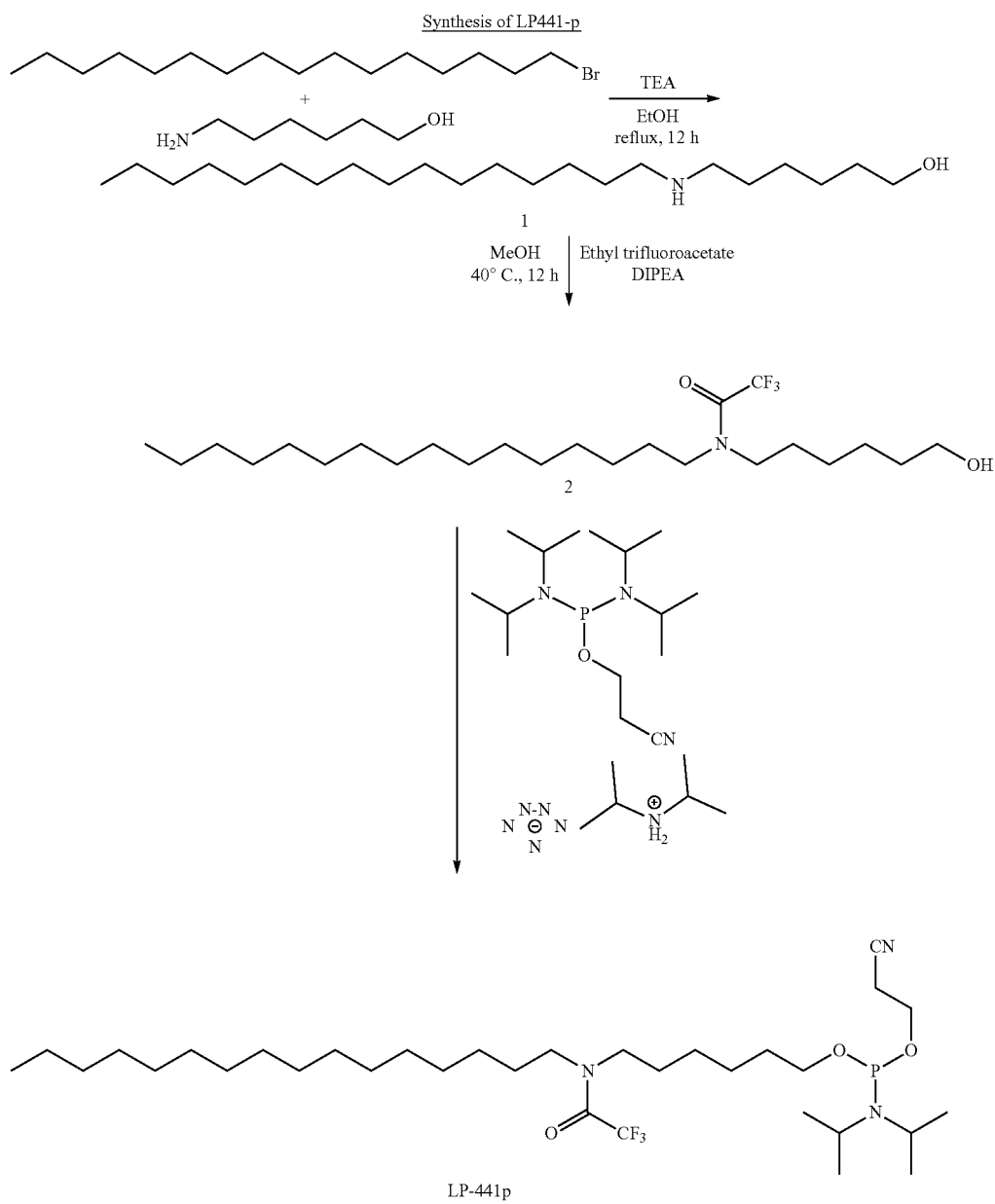

LP-441p

To a round bottom flask contain 6-amino-1-hexanol (2 eq) in EtOH (20 mL) was added 1-bromohexadecane (1 eq) and TEA (1.1 eq). This mixture was refluxed for 12 hours. Then, the solution was allowed to cool to room temperature and the solvent was removed in vacuo. Next, the crude was dissolved in $H_2O$ (20 mL) and extracted thrice with $CH_3Cl$ (3×25 mL). The combined organics were washed once with brine (20 mL), dried over $Na_2SO_4$, and concentrated under reduced pressure. The crude mixture was purfied by CombiFlash chromatography using 10% MeOH in DCM+1% TEA to give compound 1 as an oil in 44% yield. LC-MS $[M+H]^+$ 342.3736 m/z, observed 342.3728.

In a round bottom flask containing compound 1 (1 eq) in MeOH (25 mL) was added ethyl trifluoroacetate (5 eq) and DIPEA (2 eq). The reaction mixture was stirred at 40° C. for 12 hours. After, the solvent was removed under reduced pressure and the crude was purified via CombiFlash chromatography using 4%-6% MeOH in DCM to give compound 2 as an oil in 73% yield. LC-MS $[M+H]^+$ 438.3559 m/z, observed 438.3551.

Compound 2 (1 eq) was dried by two evaporations of toluene. Then, it was dissolved in anhydrous DCM (10 mL) and diisopropylammonium tetrazolide (0.4 eq) was added followed by activated molecular sieves (100 mg). The mixture was stirred under N2 gas at room temperature for 30 minutes. Then, 2-cyanoethyl N,N,N',N'-tetraisopropylphosphorodiamidite (1.5 eq) was added and stirring was continued at room temperature for 12 hours. After, 0.3 mL of TEA was added to quench the reaction and the mixture was directly loaded onto celite. CombiFlash chromatography using hexanes: ethyl acetate+1% TEA (70:30) to give pure product as a waxy, off-white solid in 56% yield. LC-MS $[M+H]^+$ 638.4637 m/z, observed 638.4629.

Synthesis of LP456-p
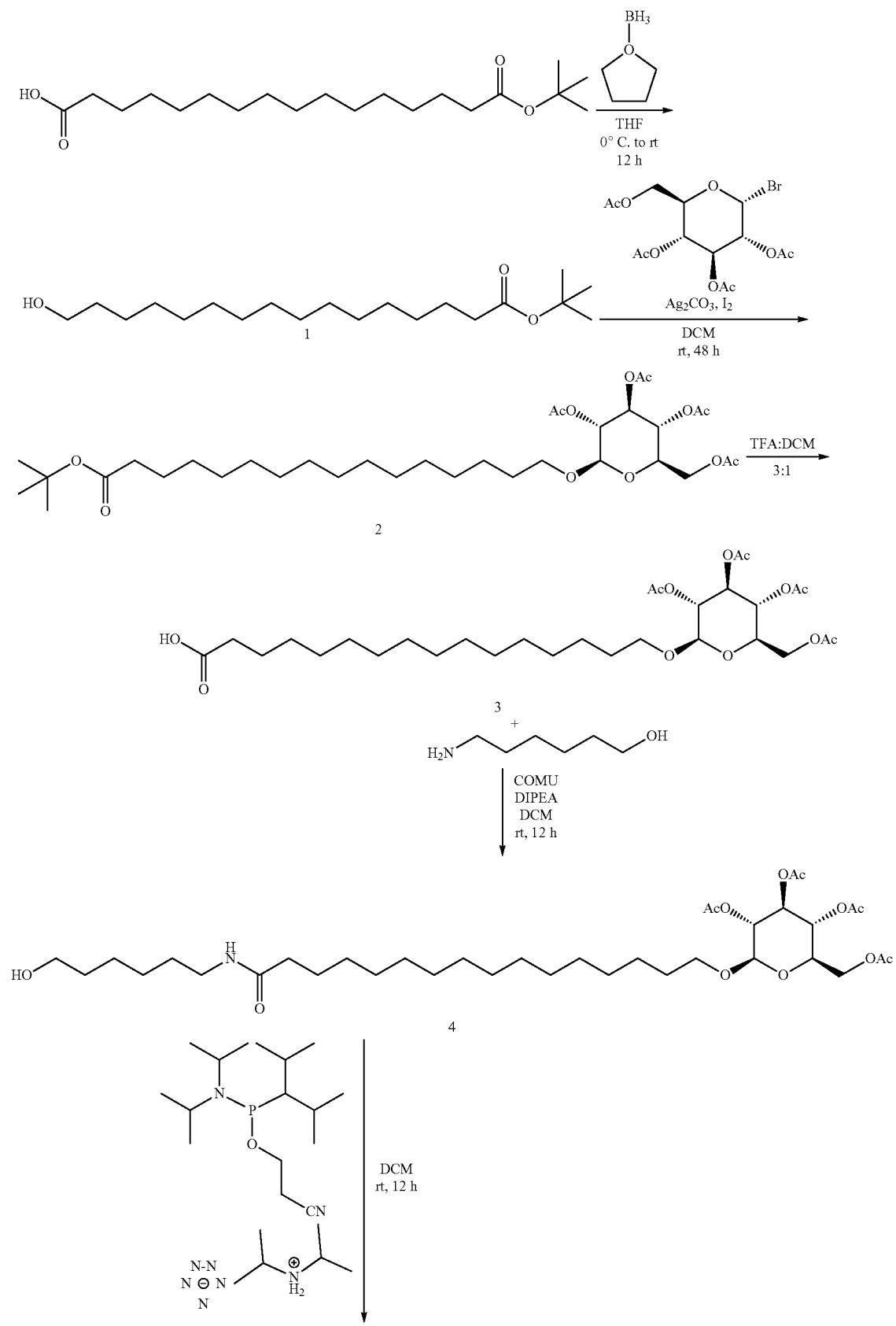

-continued

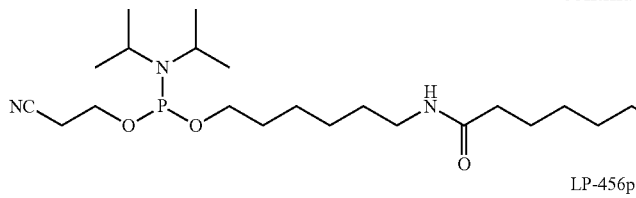 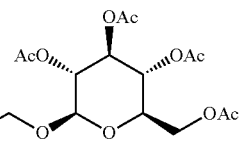

LP-456p

A 1 M solution of borane-tetrahydrofuran complex in tetrahydrofuran (1.5 eq) was added dropwise to a solution of 16 (tert-r (1 eq) in dry tetrahydrofuran (20 mL) at 0° C. under nitrogen. The resulting solution was stirred at 0° C. for 2 hours, then the cooling bath was removed, and the mixture stirred at room temperature overnight. A saturated aqueous solution of sodium bicarbonate (50 mL) was added to quench the reaction. Then, the mixture was diluted with water (50 mL) and extracted thrice with DCM (3×50 mL). The combined organics were dried over $Na_2SO_4$ and concentrated under reduced pressure. The crude was purified via CombiFlash chromatography using hexane: ethyl acetate (80:20) to give compound 1 as an oil in 82% yield. LC-MS $[M+H]^+$ 329.3056 m/z, observed 329.5060.

A mixture of compound 1 (1 eq), silver carbonate (3 eq), and a catalytic amount of iodine in DCM (5 mL) was stirred with molecular sieves for 15 min. To the mixture was added 2,3,4,6-Tetra-O-acetyl-alpha-D-glucopyranosyl bromide (1.5 eq) in DCM (5 mL) (also stirred with molecular sieves for 15 min). The resulting mixture was covered with aluminum foil and stirred at room temperature for 48 hours, then filtered through celite with EtOAc washing. The filtrate was concentrated, and the crude was purified via CombiFlash column chromatography using hexanes: ethyl acetate (80:20) to give compound 2 as an oil in 33% yield. LC-MS: $[M+H_2O]^+$ 676.4034 m/z, observed 676.4041.

To a solution of compound 2 in DCM (5 mL) was added TFA (15 mL). The solution was stirred for 2 hours at room temperature. After, the mixture was carefully poured into 100 mL of saturated $NaHCO_3$ (aq) solution. Once neutralized, the aqueous phase was extracted thrice with DCM (3×100 mL). The combined organics were dried over $Na_2SO_4$ and concentrated under reduced pressure to give compound 3 as a white solid in 97% yield. LC-MS: $[M+H]^+$ 603.3381 m/z, observed 603.3388.

To a solution of compound 3 (1 eq) in DCM (10 mL) was added COMU (1.2 eq) and DIPEA (2 eq). This mixture was stirred at room temperature for 30 minutes. Then, 6-amino-1-hexanol (1.2 eq) was added and the reaction mixture was stirred at room temperature for 12 hours. Then, the mixture was washed thrice with 1 M HCl (3×10 mL), once with brine (10 mL), dried over Na2SO4, and concentrated under reduced pressure. The crude was purified via CombiFlash chromatography using 0-100% hexanes:ethyl acetate over 40 minutes to give compound 4 as an oil in 83% yield. LC-MS $[M+H]^+$ 702.4429 m/z, observed 702.4421.

Compound 4 (1 eq) was concentrated by rotary evaporator twice with toluene before charging anhydrous DCM (10 mL) to the reaction flask. The suspension was stirred 900 RPM under N2 at ambient temperature with molecular sieves. 2-Cyanoethyl N,N,N',N'-tetraisopropylphosphordiamidite (1.5 eq) was added to the suspension, followed by diisopropylammonium tetrazolide (0.4 eq). After 12 hours, TEA (300 uL) was added, and the reaction mixture was dry loaded onto celite. The product was purified using hexanes: ethyl acetate+1% TEA (60:40) to give LP-456p as an oil in 64% yield. LC-MS $[M+H]^+$ 902.5507 m/z, observed 902.5517.

Synthesis of LP462-p

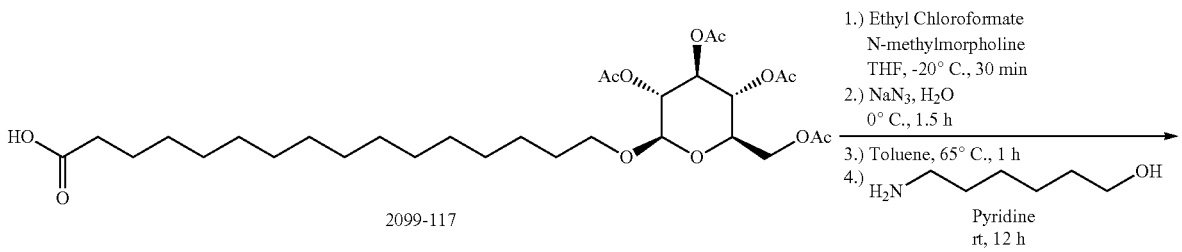

2099-117

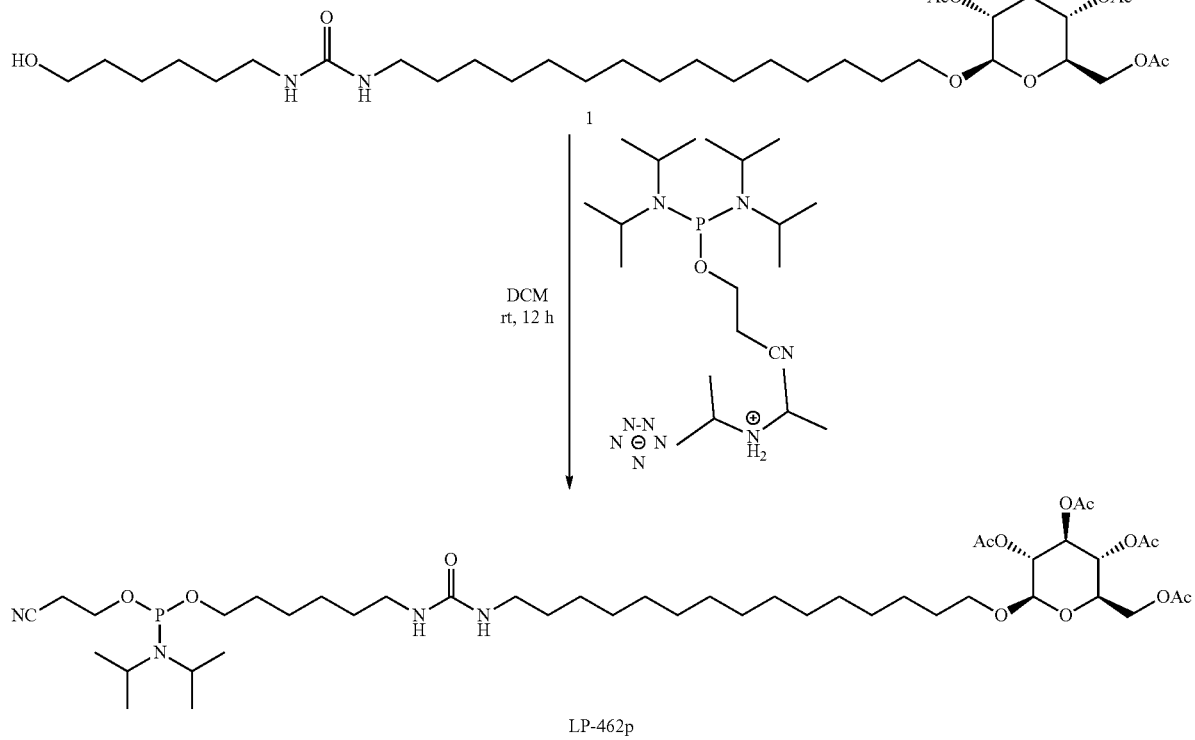

LP-462p

To a round bottom flask containing 2099-117 (1 eq) was added anhydrous THF (30 mL) and the solution was cooled to −20° C. Ethyl chloroformate (1.2) and N-methylmorpholine (1.2 eq) were added to the solution and the solution was stirred at −20° C. to −10° C. for 30 minutes. A solution of sodium azide (2.5 eq) in 1.5 mL of water was added to the reaction and the reaction was stirred at −7° C. for 90 minutes. The reaction was diluted with EtOAc. The aq. layer was separated and extracted 2 additional times with EtOAc. The combined organic layers were washed with brine, dried over Na2SO4, and concentrated to a clear liquid. The liquid was dissolved in toluene (30 mL) and heated to 65° C. for 1 hour, when no additional nitrogen gas formation was observed. Next, the solution was concentrated under reduced pressure and then dissolved in 30 mL of anhydrous DCM. 6-amino-1-hexanol (3 eq) and pyridine (1 eq) were added to the reaction mixture and stirring was continued for 12 hours. The mixture was concentrated under reduced pressure onto celite and purified via CombiFlash chromatography using 5% methanol in 95% DCM to give compound 1 as an oil in 51% yield. LC-MS [M+H$_2$O]$^+$ 717.4538 m/z, observed 717.4530.

Compound 1 (1 eq) was rotovaped twice with toluene before charging anhydrous DCM (10 mL) to the reaction flask. The suspension was stirred 900 RPM under N2 at ambient temperature with molecular sieves. 2-Cyanoethyl N,N,N',N'-tetraisopropylphosphordiamidite (1.5 eq) was added to the suspension, followed by diisopropylammonium tetrazolide (0.4 eq). After 12 hours, TEA (300 uL) was added, and the reaction mixture was dry loaded onto celite. The product was purified using hexanes: ethyl acetate+1% TEA (60:40) to give LP462-p as an oil in 64% yield. LC-MS [M+H]$^+$ 916.5538 m/z, observed 916.5543.

Synthesis of LP463-p

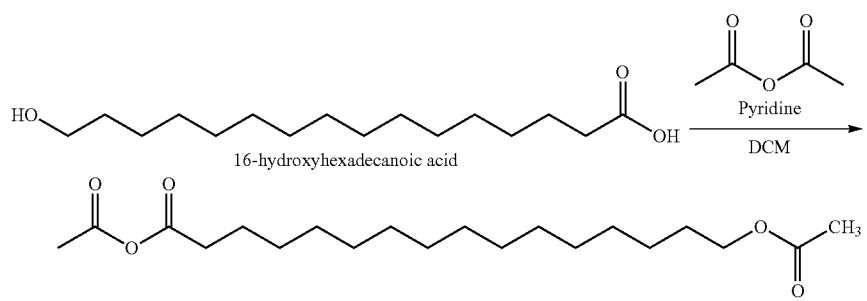

16-hydroxyhexadecanoic acid

24

To a solution of 16-hydroxyhexadecanoic acid (1.5 g, 5.5 mmol) in DCM (60 mL) was added acetic anhydride (8.3 mL, 88 mmol) followed by pyridine (13.75 mL, 171 mmol) at room temperature. The mixture was stirred at room temperature overnight. After removing solvent in vacuo, the residue was redissolved in DCM and dry-loaded on a 80 g column. Hexanes to 50% EtOAc in Hexanes was used to purify. Compound 24 was obtained as a white solid, 1.22 g, 62%. LC-MS: calculated [M+H+H$_2$O] 375.27, found 374.80.

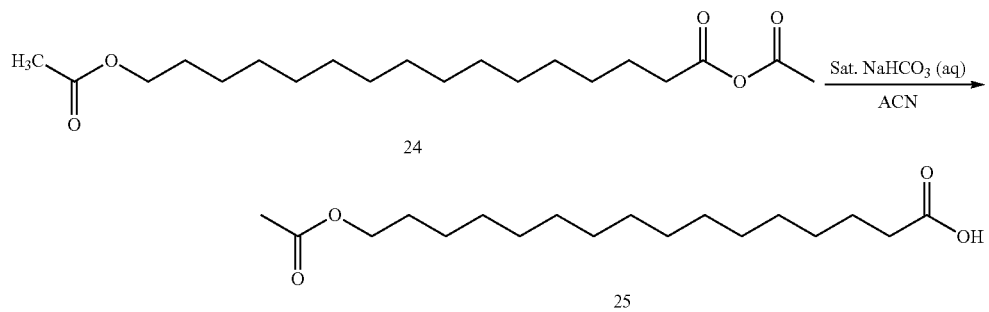

A suspension of compound 24 (1.22 g, 3.4 mmol) in ACN (40 mL) and sat. aq. NaHCO$_3$ (10 mL) was stirred at room temperature overnight. The pH was adjusted to 1 with 1 N HCl. The precipitate was collected by suction filtration and was washed with H$_2$O and air dried to yield 1.15 g (107% yield) of compound 25 is as a white solid. Greater than 100% yield due to residual water as determined by $^1$H NMR. LC-MS: calculated [M+H]315.25, found 315.59.

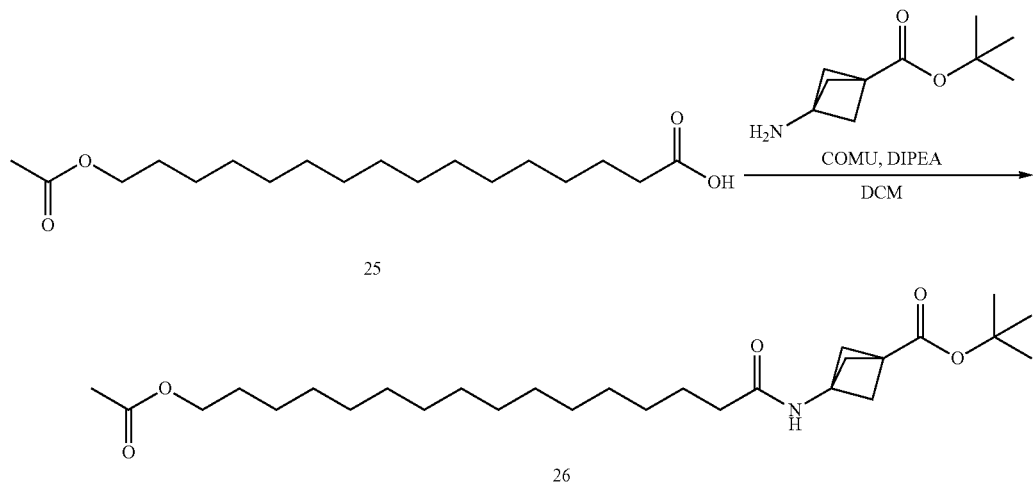

To a solution of compound 25 (1.15 g, 3.66 mmol) and diisopropylethylamine (1.28 mL, 7.3 mmol) in DCM (40 mL) was added COMU (1.8 g, 4.4 mmol) and tert-butyl 3-aminobicyclo[1.1.1]pentane-1-carboxylate (0.81 g, 4.4 mmol) at room temp. The mixture was stirred at room temp for 2 hours. The reaction mixture was concentrated onto silica gel and purified by column chromatography, 100% Hexanes:0% EtOAc to 0% Hexanes:100% EtOAc. Fractions containing product were combined and solvent was removed via rotary evaporator to yield 1.66 g (94% yield) of compound 26 as a brown solid. LC-MS: calculated [M+H] 480.37, found 480.76.

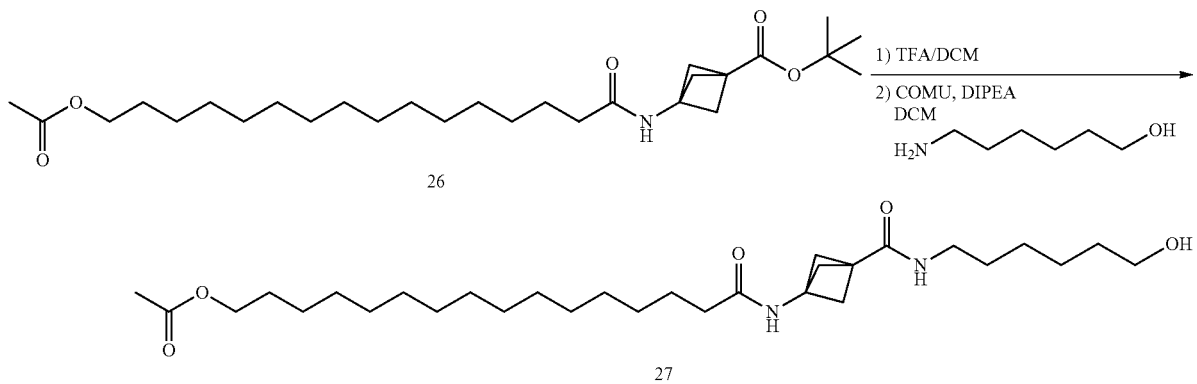

To a solution of compound 26 in DCM (10 mL) TFA (10 mL) was added, and the reaction was stirred at room temperature for 1.5 hours. After removing solvent in vacuo, the residue was dried under high vacuum for 2 hours. The residue was dissolved in DCM (30 mL) and diisopropylethylamine (1.2 mL, 6.9 mmol). After the residue was dissolved, COMU (1.77 g, 4.1 mmol) and 6-amino-1-hexanol (0.49 g, 4.1 mmol) were added at room temperature. The mixture was stirred at room temperature for 2.5 hours. After removing part of the solvent in vacuo, the residue was recrystallized with ACN. Product was collected by suction filtration and dried in vacuo to yield 1.48 grams (82% yield) of compound 27 as an off-white solid. LC-MS: calculated [M+H] 523.41, found 524.06.

To a mixture of compound 27 (0.3 g, 0.57 mmol) in DCM (20 mL) was added Diisopropylammonium tetrazolide (0.039 g, 0.23 mmol) followed by drop wise addition of 2-cyanoethyl N,N,N',N'-tetraisopropylphosphorodiamidite (0.277 g, 0.92 mmol) at room temperature. Then the mixture was refluxed 2 hours. After cooling to room temperature, the mixture was washed by sat. NaHCO$_3$ (aq) twice followed by H$_2$O. After removing almost all solvent in vacuo, the residue was added to stirred hexanes and a white gel precipitate formed. After filtration, the white solid was collected by suction filtration and washed twice with hexanes. The white solid was dried under high vacuum to yield 0.305 g (73% yield) of compound LP463-p as a white solid. LC-MS: calculated [M+H] 723.52, found 724.23.

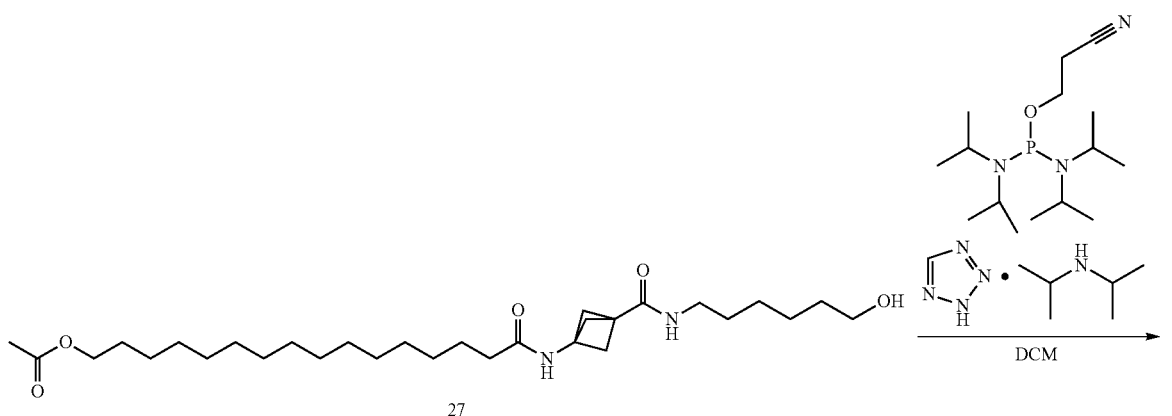

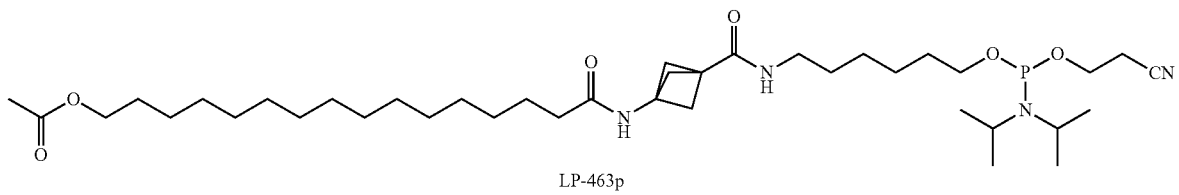

Synthesis of LP464-p

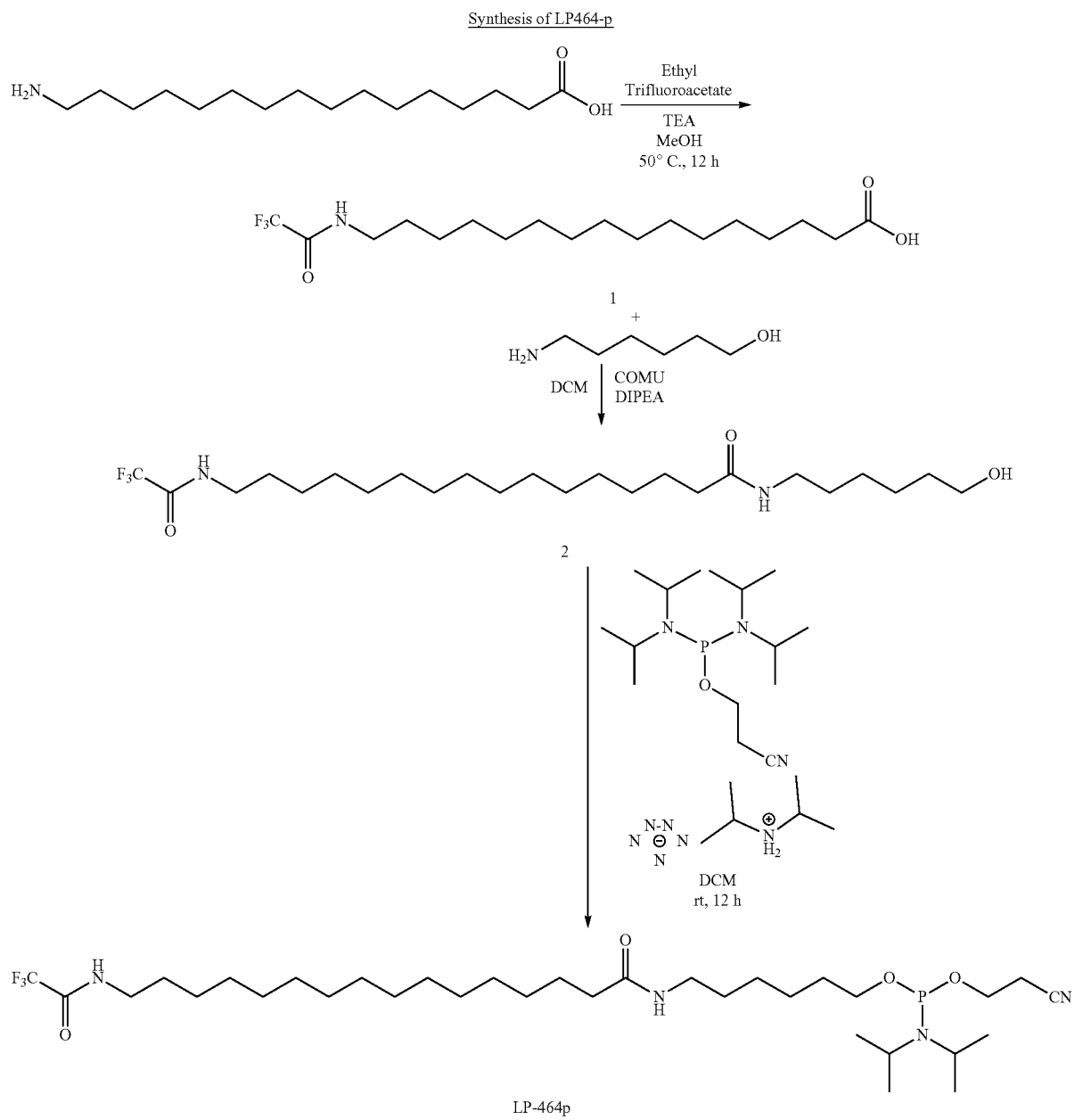

To a solution of 16-amino-hexadecanoic acid (1 eq) in anhydrous MeOH (20 mL) was added ethyl trifluoroacetate (1.5 eq) and TEA (1.1 eq). The reaction was stirred under nitrogen atmosphere for 12 hours at 50° C. Then, the mixture was concentrated under reduced pressure, diluted with EtOAc (30 mL) and washed twice with saurated $KHSO_4$ (15 mL), once with brine (15 mL), dried over $Na_2SO_4$, and concentrated under reduced pressure to give compound 1 as a white solid in 79% yield. LC-MS $[M+H]^+$ 368.2412 m/z, observed 368.2419.

To a solution of compound 1 (1 eq) in DCM (30 mL) was added COMU (1.2 eq) and DIPEA (2 eq). This mixture was stirred at room temperature for 30 minutes. Then, 6-amino-1-hexanol (1.2 eq) was added and the reaction mixture was stirred at room temperature for 12 hours. Then, the mixture was washed thrice with 1 M HCl (3×15 mL), once with brine (15 mL), dried over $Na_2SO_4$, and concentrated under reduced pressure. To the crude product was added ACN (100 mL) and carefully heated using the heatgun until all solids were soluble. This mixture was then left at room temperature which gave white crystals to form. The precipitate was then collected via vacuum filtration and washed several times with ACN to get rid of residual pink color. Compound 2 was obtained as white solid in 82% yield. LC-MS $[M+H]^+$ 467.3461 m/z, observed 467.3457.

Compound 2 (1 eq) was concentrated on rotary evaporator twice with toluene before charging anhydrous DCM (10 mL) to the reaction flask. The suspension was stirred 900 RPM under N2 at ambient temperature with molecular sieves. 2-Cyanoethyl N,N,N',N'-tetraisopropylphosphordiamidite (1.5 eq) was added to the suspension, followed by diisopropylammonium tetrazolide (0.4 eq). After 12 hours, TEA (300 uL) was added, and the reaction mixture was dry loaded onto celite. The product was purified using hexanes:

ethyl acetate+1% TEA (60:40) to give LP464-p as waxy solid in 77% yield. LC-MS [M+H]+ 667.4539 m/z, observed 667.4544.

Synthesis of LP465-p

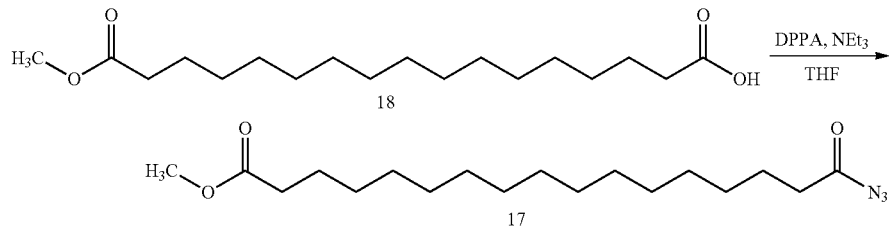

17-methoxy-17-oxohexadecanoic acid (1.0 g, 3.2 mmol) was dissolved in THF (50 mL) and triethylamine (0.89 mL, 6.4 mmol) and DPPA (0.75 mL, 3.5 mmol) were added. The reaction was stirred overnight. The reaction mixture was concentrated and the crude product was purified buy silica gel chromatorgraphy (20:80 EtOAc:Hexanes to 100:0 EtOAc:Hexanes). The product eluted at 10% EtOAc. Fractions 1-4 were found to contain product were concentrated to yield 0.60 g (56% yield) of compound 17 as a white solid.

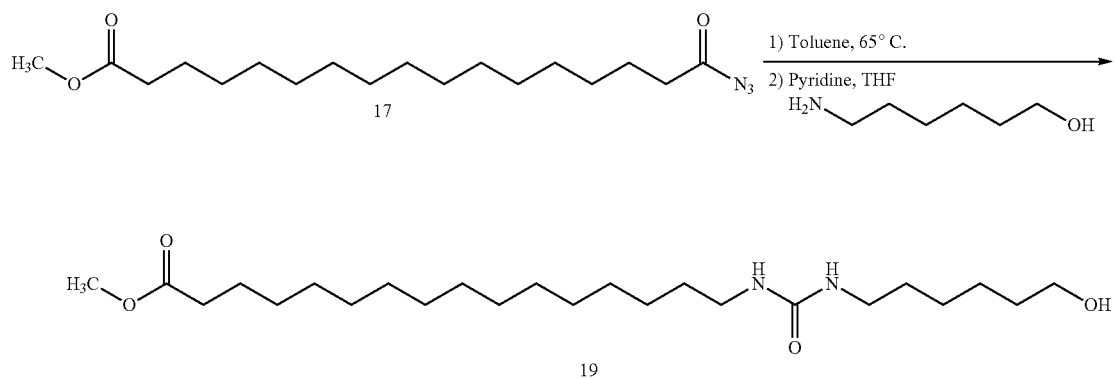

Compound 17 (0.58 g, 1.7 mmol) was dissolved in toluene (20 mL) and was heated to 65° C. until no more gas evolution was observed (30 minutes). The solution was cooled to room temperature then added to a solution of 6-amino-1-hexanol (0.2 g, 1.7 mmol) and pyridine (0.14, 1.7 mmol) in THF (20 mL). The reaction mixture was diluted with acetonitrile and the precipitate was collected by suction filtration, rinsed with acetonitrile, hexanes and dried in vacuo to yield 0.614 g (84% yield) of compound 19 as a white solid.

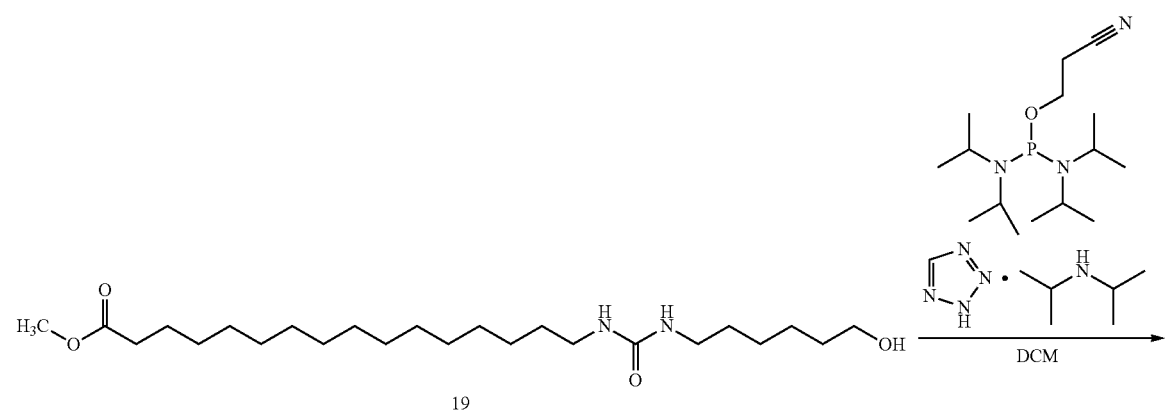

-continued

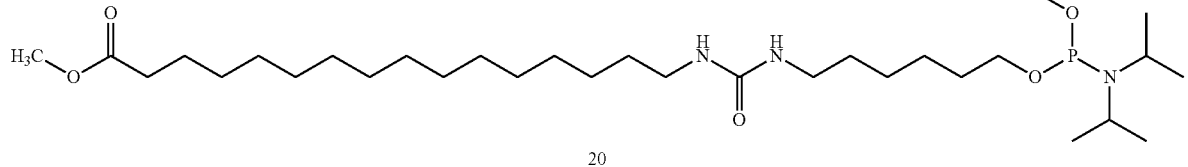

20

In a 100 mL RBF compound 19 (0.60 g, 1.4 mmol) was dried by 3 successive evaporations of toluene. Diisopropylammonium tetrazolide (0.096 g, 0.56 mmol) and 4 angstrom molecular sieves were added to the flask. The flask was purged and backfilled with nitrogen 3 times, and the solids were suspended in DCM (40 mL). The solids only partially dissolved. To the mixture, 2-cyanoethyl N,N,N',N'-tetraisopropylphosphorodiamidite (0.65 g, 2.2 mmol) was added and the reaction was stirred for 18 hours. LC-MS after 18 hours indicated no starting alcohol remained. The reaction was transferred to a separatory funnel, washed with sat. aq. NaHCO₃ (2×40 mL), water (40 mL), and concentrated to dryness. Hexanes was added to the flask and the residue was stirred in hexanes for 2 hours to yield a white precipitate. The white solid was collected by filtration, washed with hexanes (2×20 mL), and dried under vacuum to yield 0.678 grams (77% yield) of LP465-p as a white solid.

Synthesis of LP466-p

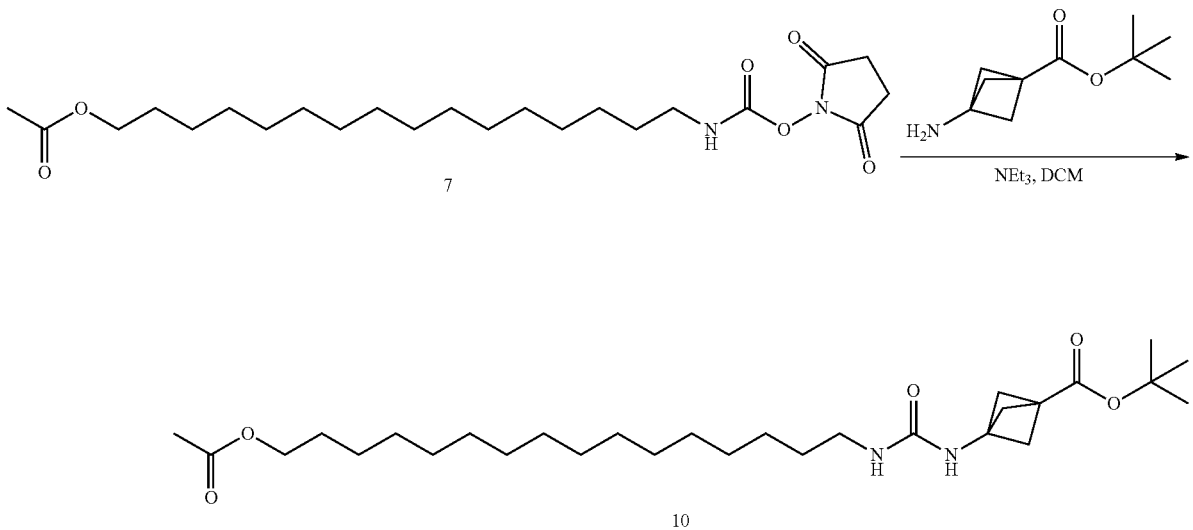

Compound 7 (0.22 g, 0.50 mmol) and tert-butyl 3-aminobicyclo[1.1.1]pentane-1-carboxylate (0.0915 g, 0.50 mmol) were dissolved in DCM (10 mL) and triethylamine (0.21 mL, 1.5 mmol) was added. After 18 hours, <2% of the starting NHS ester remained by LC-MS. The reaction mixture was concentrated and loaded directly on to a silica gel column for purification. The product was purified by column chromatography 0% EtOAc/100% hexanes to 50% EtOAc 50% hexanes. Fractions 3-5 were combined to yield 0.23 g (89% yield) of compound 10 as a white solid.

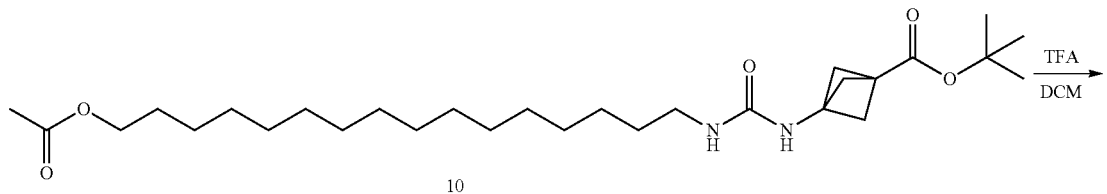

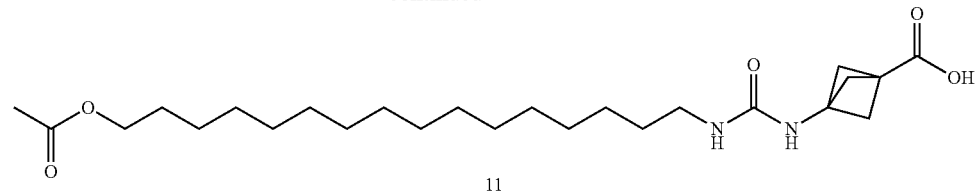

11

Compound 10 (0.23 g, 0.45 mmol) was dissolved in DCM (3 mL) and trifluoroacetic acid (3 mL) was added. The solution was stirred overnight. No SM was present by LC-MS after 18 hours. The reaction mixture was concentrated and the residual TFA was removed by 2 co-evaporations with toluene to yield 0.189 mg (93%) of compound 11 as a white solid.

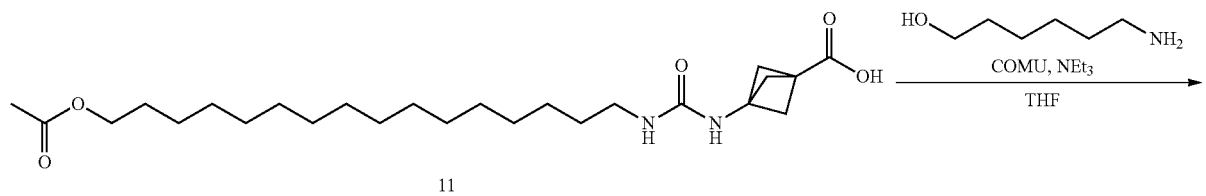

11

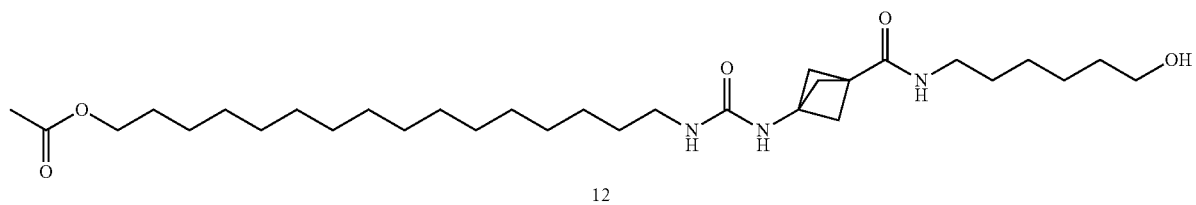

12

Compound 11 (0.189 g, 0.48 mmol) and COMU (0.215 g, 0.5 mmol) were dissolved in DCM (10 mL) and triethylamine (0.333 mL, 2.4 mmol) was added. The reaction was stirred for about 5 minutes, then 6-amino-1-hexanol (0.059 g, 0.5 mmol) was added. After 1 hour, no starting material remained by LC-MS. The reaction mixture was concentrated, and water was added to the residue. The mixture was sonicated until all of the material was suspended in water and the precipitate was collected by filtration and washed 3 times with water. The precipitate was dried in vacuo to yield 0.166 g (70% yield) of compound 12 as a white solid.

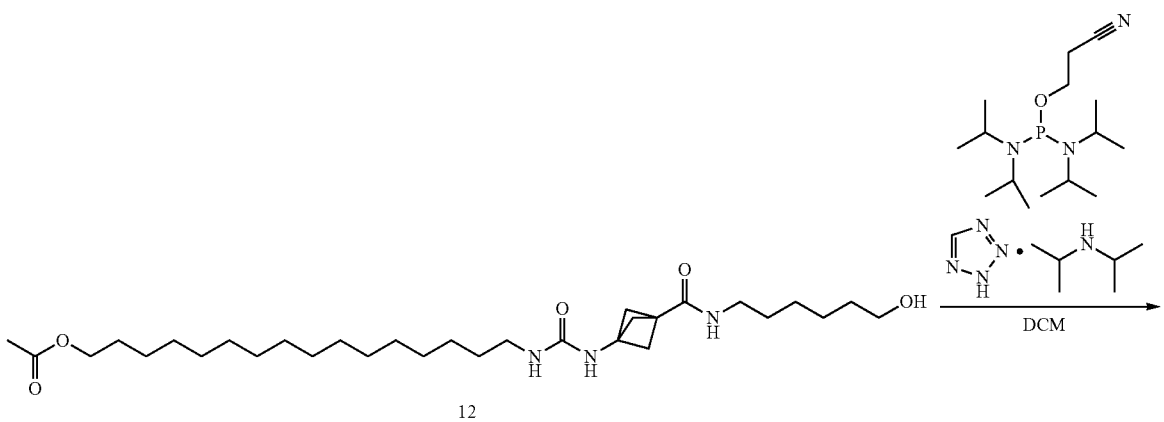

12

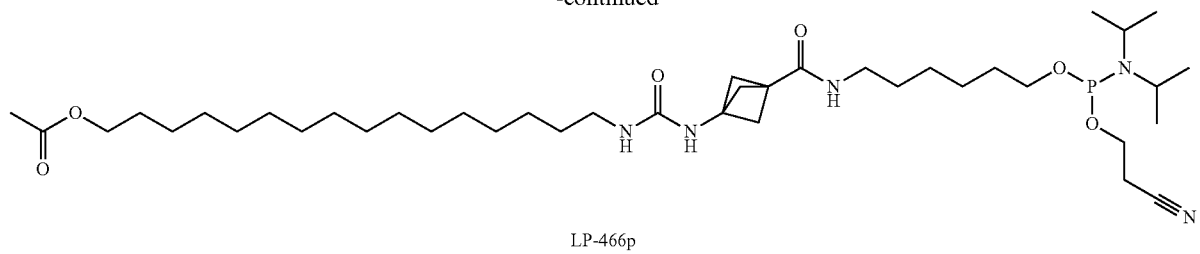

LP-466p

In a 100 mL RBF compound 12 (0.166 g, 0.3 mmol) was dried by 2 successive evaporations of toluene. Diisopropylammonium tetrazolide (0.02 g, 0.12 mmol) and 4 angstrom molecular sieves were added to the flask. The flask was purged and backfilled with nitrogen 3 times, and the solids were suspended in DCM (20 mL). The solids only partially dissolved. To the mixture 2-cyanoethyl N,N,N',N'-tetraisopropylphosphorodiamidite (0.14 g, 0.46 mmol) was added and the reaction was stirred for 18 hours. LC-MS indicated no starting alcohol remained after 18 hours. The reaction was transferred to a separatory funnel, washed with sat. aq. NaHCO$_3$ (2×40 mL), water (40 mL), brine (40 mL), dried over magnesium sulfate and concentrated to dryness. Hexanes was added to the flask and the residue was stirred in hexanes for 1 hour to yield a white precipitate. The white solid was collected by filtration, washed with hexanes (2×20 mL), and dried under vacuum to yield 0.116 grams (510% yield) of LP-466p as a white waxy solid.

Synthesis of LP493-p (shown as LP493-p uridine)

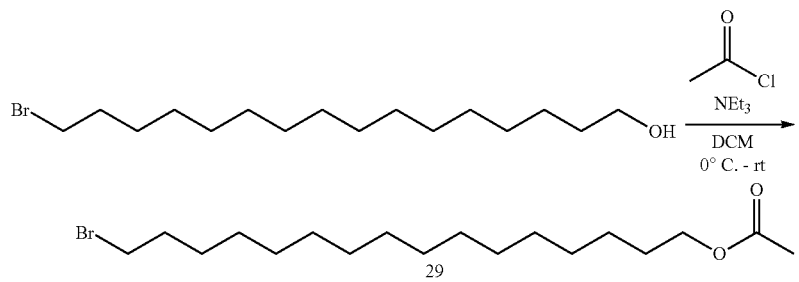

To a solution of 1-bromohexadecan-16-ol (6.0 g, 18.7 mmol) in DCM (90 mL) was added triethylamine (2.9 mL, 20.5 mmol). The resulting solution was cooled to 0° C. in an ice/water bath. After cooling, acetyl chloride (1.46 mL, 20.5 mmol) was added dropwise. The reaction was stirred at 0° C. for 1 hour after the addition was complete then allowed to warm to room temperature and stirred overnight. After about 18 hours, the reaction mixture was washed with sat. NaHCO$_3$ (20 mL), water, 1 M HCl (20 mL), water (2×20 mL), brine (20 mL), dried over sodium sulfate and concentrated to a white solid. The crude product was purified buy silica gel chromatorgraphy (0:100 EtOAc:Hexanes to 20:80 EtOAc:Hexanes) The product eluted at 10% EtOAc. Fractions 5-12 were concentrated to yield 6.02 g (89% yield) of compound 29 as a white powder.

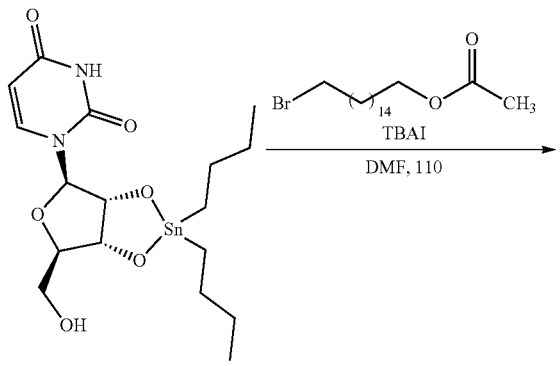

-continued

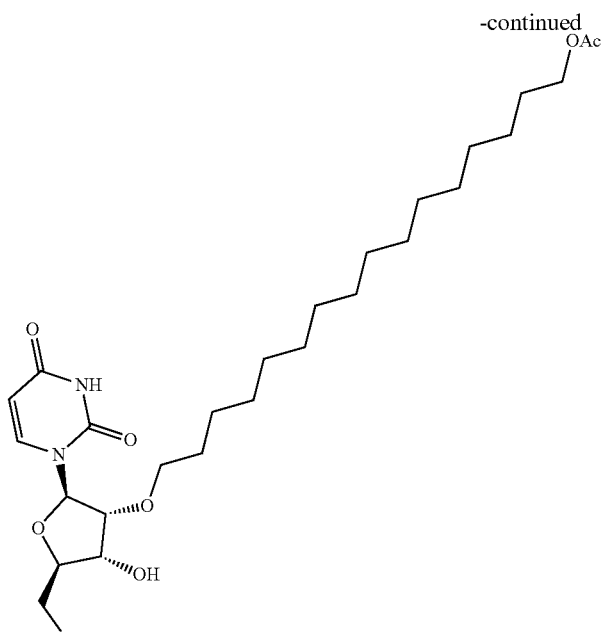

30

Compound 31 was prepared according to the literature procedure. Compound 31 (1.0 g, 2.1 mmol), Compound 29 (1.53 g, 4.2 mmol), and tetrabutyl ammonium iodide (1.6 g, 0.42 mmol) were placed in an oven dried flask. The flask was evacuated and purged with nitrogen three times, then dry DMF (10 mL) was added to the flask. The solution was heated to 110° C. for 18 hours. After 18 hours the reaction was cooled to room temperature and the solvent was removed in vacuo. The residue was resuspended in DCM/MeOH and concentrated onto silica gel for purification. The column was eluted with 3% MeOH/97% DCM to 20% MeOH/80% DCM. Fractions containing the 2' and 3' addition products were pooled and concentrated to yield 0.236 g (21% yield) of compound 30 plus the 3' addition product.

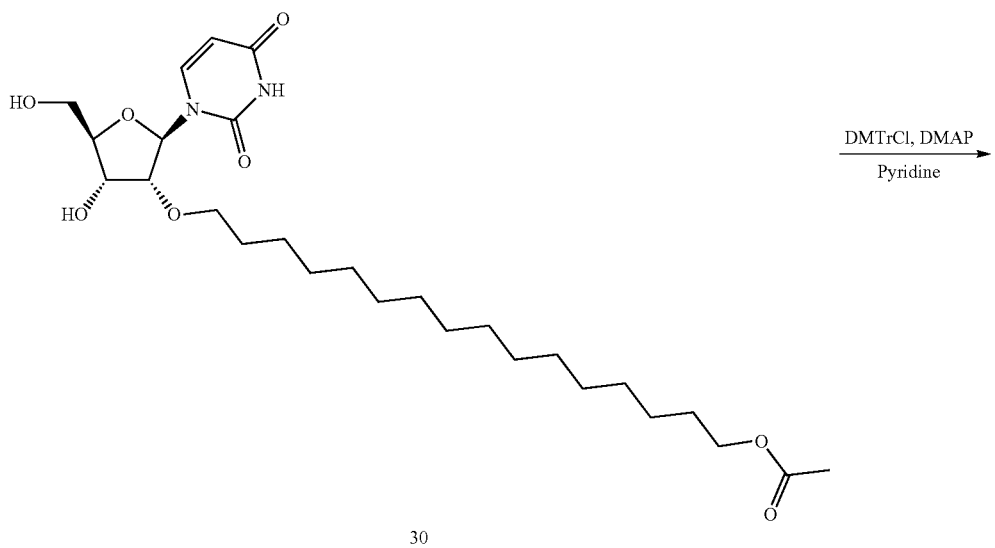

30

$\xrightarrow{\text{DMTrCl, DMAP}}{\text{Pyridine}}$

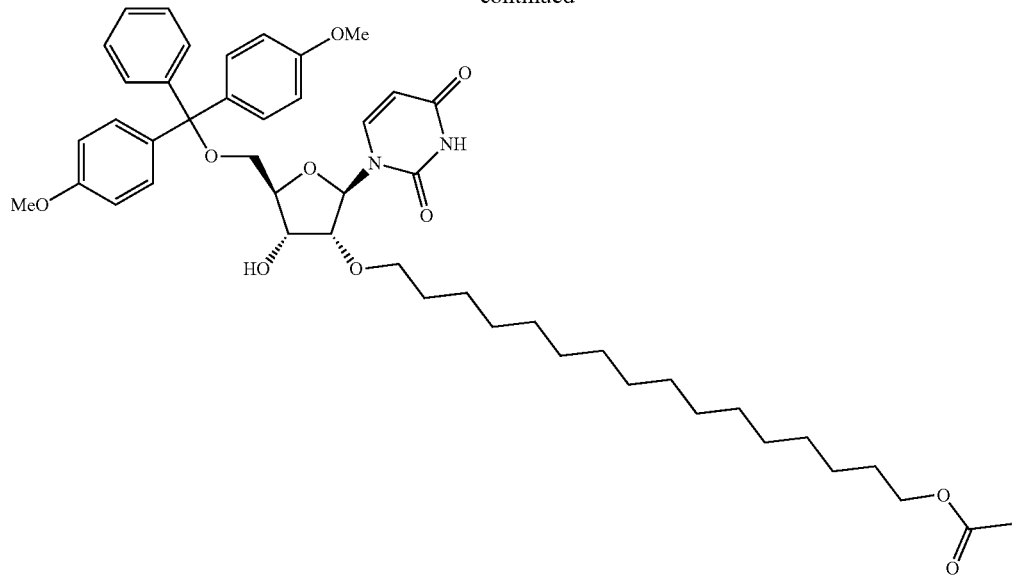

32

Compound 30+3' addition product (0.23 g, 0.44 mmol) was dried by successive evaporations of toluene and anhydrous pyridine using a rotary evaporator. DMAP (0.003 g, 0.022 mmol) and dimethoxytrityl chloride (0.165 g, 0.49 mmol) were added to the flask and the flask was evacuated and purged with nitrogen 3 times. The solids were dissolved in of pyridine (10 mL). The reaction was stirred overnight at room temperature. All volatiles were removed, residual pyridine was removed by co-distillation with toluene. The residue was partitioned between DCM (20 mL) and aqueous NaHCO$_3$ (20 mL). The organic phase was separated, the aqueous was extracted with DCM (20 mL), combined organic phases were dried (Na$_2$SO$_4$) and concentrated. The crude product was purified by silica gel chromatography. Silica was pretreated with a 50:50 mixture of Hexanes/EtOAc+2% v/v triethylamine. The product was isolated on CombiFlash using 40 g column, eluent: hexane-ethyl acetate+1% of Et$_3$N, 20-60% Compound eluted at 60% EtOAc. Late fractions were contaminated with 3' alkylated product. Fractions containing pure 2' alkylated product were combined and concentrated to yield 0.107 g (27% yield) of compound 32 as a white solid.

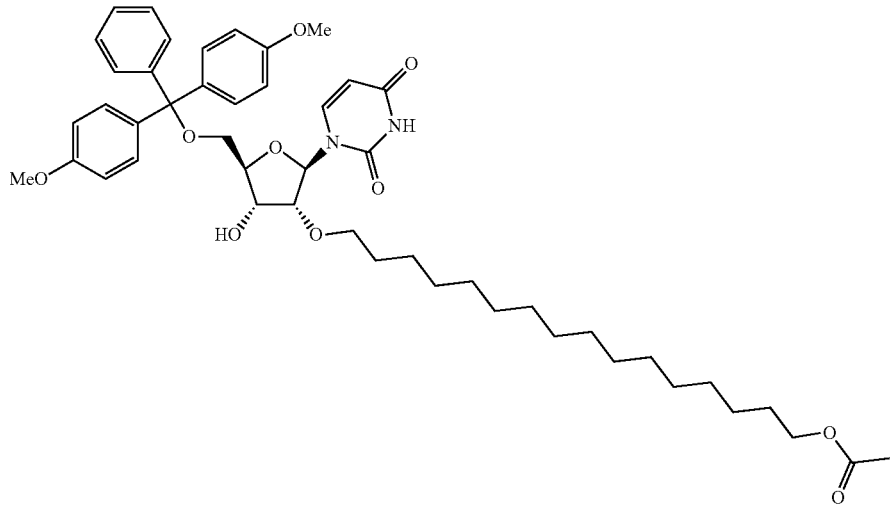

32

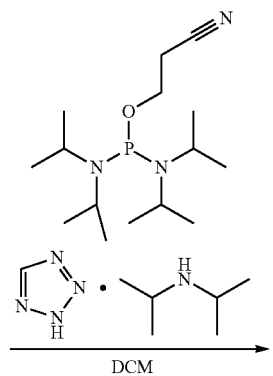

DCM

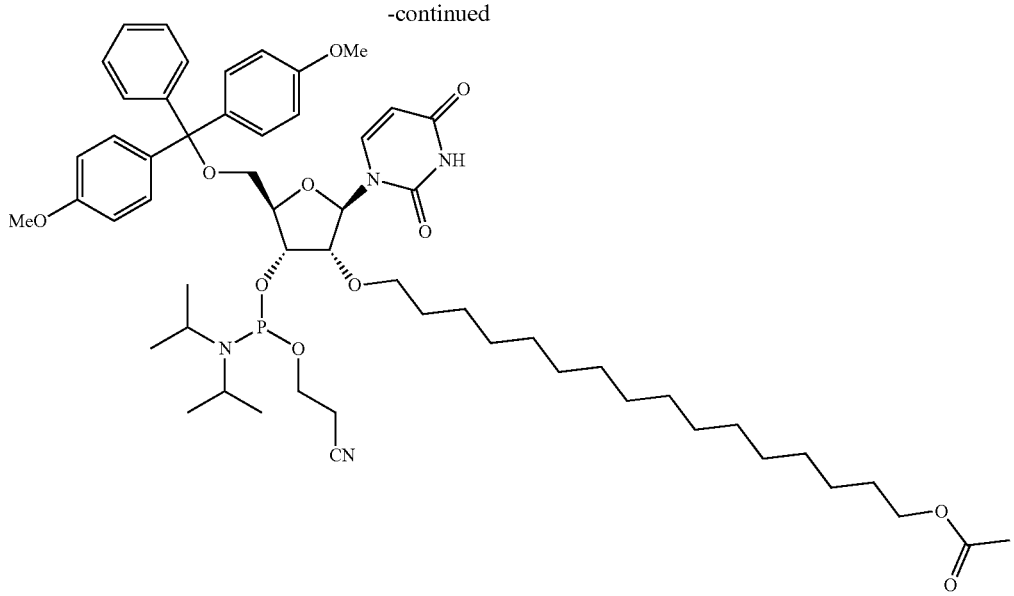

33

In a 25 mL RBF, Compound 32 (0.150 g, 0.18 mmol) and diisopropylamonium tetrazolide (0.043 g, 0.25 mmol), and 4 angstrom molecular sieves, were placed and the flask was evacuated purged with nitrogen 3 times. DCM (5 mL) was added, followed by the dropwise addition of 2-cyanoethyl N,N,N',N-tetraisopropylphosphorodiamidite (0.092 mL, 0.29 mmol). The reaction was stirred overnight. The reaction mixture was quenched with ~2 mL Sat. NaHCO$_3$, filtered into a separatory funnel, the layers were separated and the NaHCO$_3$ layer was extracted 1 additional time with DCM (10 mL). The combined organic layers were dried over Na$_2$SO$_4$ and concentrated to a thick viscous liquid. The crude product was purified buy silica gel chromatography (0:100 EtOAc:Hexanes to 100:0 EtOAc:Hexanes.) Silica was pretreated with a 50:50 mixture of Hexanes/EtOAc+2% v/v triethylamine. The product eluted at 45% EtOAc. Fractions 15-35 were found to contain product with little oxidized product contamination and were combined to yield 0.088 g (47% yield) of compound 33 as a sticky colorless solid. Fractions 36-50 were combined to yield 44 mg of a sticky colorless solid and contained product with more oxidized material.

Synthesis of (2C8C12) phosphoramidite

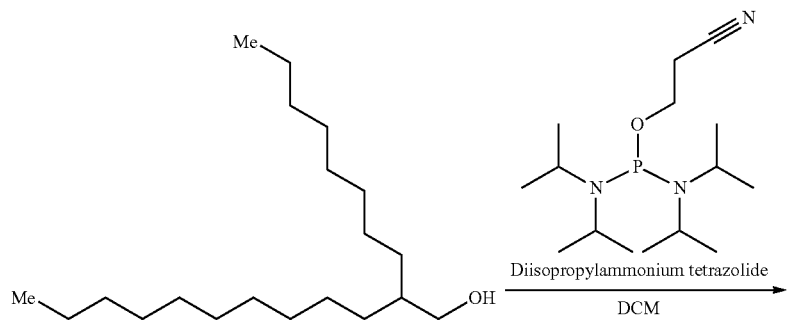

Diisopropylammonium tetrazolide
DCM

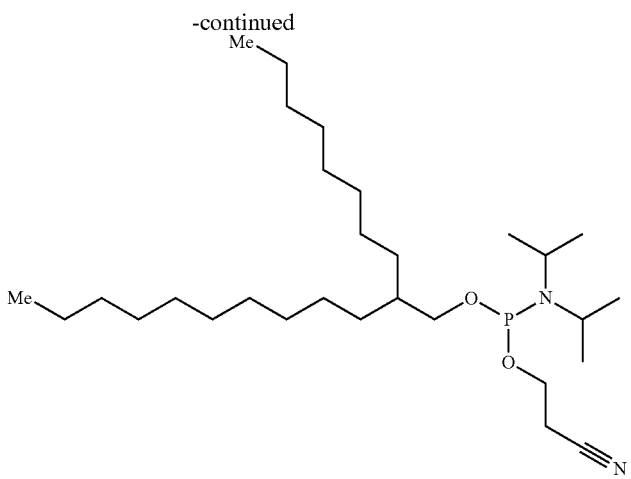

2-ocytyl-1-decanol (1.00 grams, 3.35 mmol) and diisopropylamonium tetrazolide (0.2868 grams, 1.68 mmol) were placed in a flask and the flask was purged with nitrogen. DCM (50 mL) was added to the mixture and 2-Cyanoethyl N,N,N',N'-tetraisopropylphosphorodiamidite (2.66 mL, 8.37 mmol) was added dropwise. Upon completion of the reaction, 3 mL of triethylamine was added to the reaction and the reaction was concentrated directly onto celite for purification. The crude product was purified buy silica gel chromatography (0:100 EtOAc:hexanes+2% triethylamine to 100:0 EtOAc:Hexanes+2% triethylamine) The product eluted with 100% Hexanes. Fractions containing product were concentrated to 1.268 g (76% yield) of a clear liquid.

2-hexyl-1-decanol (1.00 g, 4.13 mmol) and diisopropylamonium tetrazolide (0.353 g, 2.06 mmol) were placed in a flask and the flask was purged with nitrogen. DCM (50 mL) was added to the mixture and 2-Cyanoethyl N,N,N',N'-tetraisopropylphosphorodiamidite (3.27 mL, 10.3 mmol) was added dropwise. Upon completion of the reaction, 3 mL of triethylamine was added to the reaction and the reaction was concentrated directly onto celite for purification. The crude product was purified buy silica gel chromatography (0:100 EtOAc:hexanes+2% triethylamine to 100:0 EtOAc: Hexanes+2% triethylamine) The product eluted with 100% Hexanes. Fractions containing product were concentrated to 1.32 g (72% yield) of a clear liquid.

Synthesis of (2C6C10) phosphoramidite

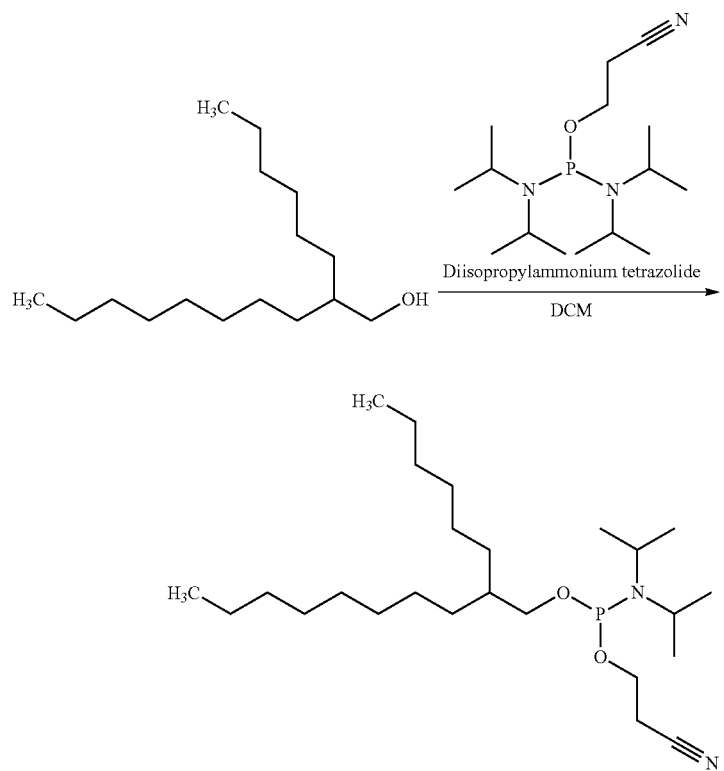

Synthesis of HO-C16 phosphoramidite

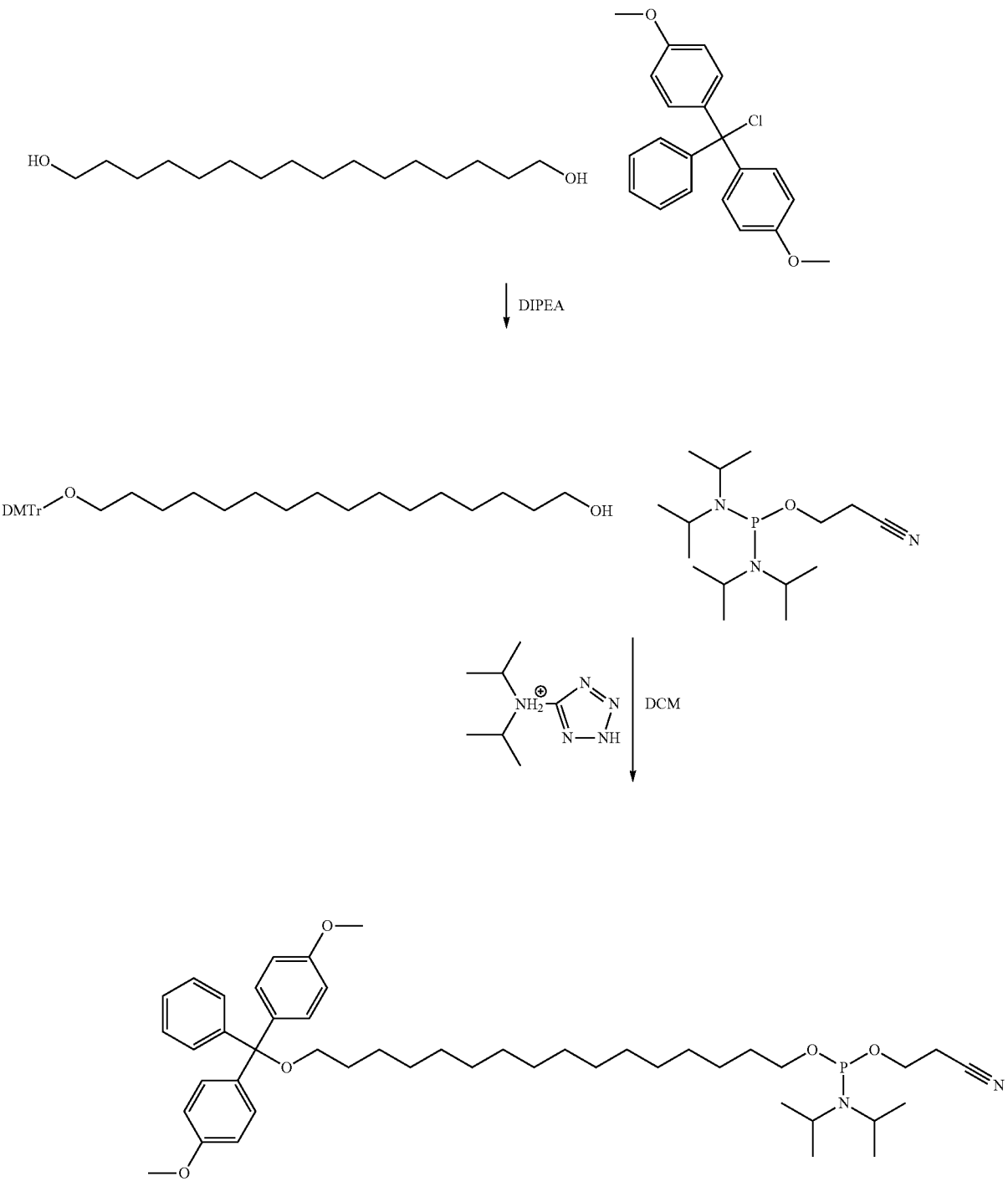

1,16-hexadecanediol, N,N-diisopropylethylamine (0.100 g) was dissolved in 2 mL THF. 4,4'-Dimethoxytrityl chloride (2.2 g, 6.6 mmol) was added slowly as a solid. After 2 h, the reaction was concentrated by rotary evaporation, and the product was purified by column chromatography (25% ethyl acetate/75% hexane).

DMT-O—$C_{16}$—OH (0.200 g), Bis(diisopropylamino)(2-cyanoethoxy)phosphine (0.227 mL) and BisDiisopropylammonium tetrazolide (0.0611 g) were dissolved in anhydrous DCM at room temperature. The reaction was capped and stirred overnight. Conversion was determined via LC-MS (0.25M $NH_4$ $HCO_3$:$H_2O$ buffer system). Celite® was added to the reaction mixture and it was concentrated under vacuum until a white powder remained. The mixture was loaded dry onto a silica column (12 gram) using a EtOAc/Hexanes (1% Triethylamine) solvent system to prevent hydrolysis from the silica gel.[1] The product was characterized by $^{31}$PNMR, $^{1}$HNMR, and LC-MS.

Synthesis of C16 phosporamidite

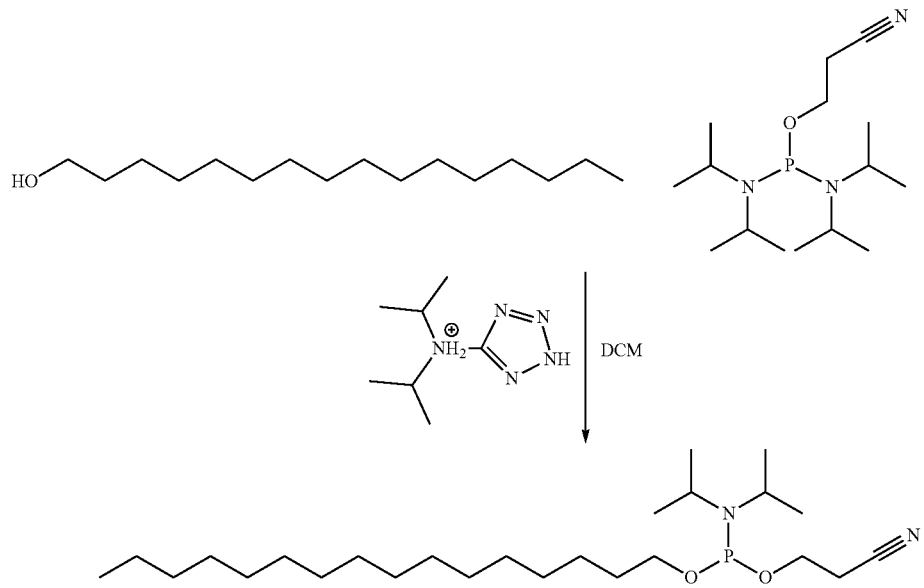

Cetyl alcohol (1.10 g), Bis(diisopropylamino)(2-cyanoethoxy)phosphine (2.88 mL) and BisDiisopropylammonium tetrazolide (0.778 g) were dissolved in a solution of DCM at room temperature. The reaction was capped and stirred overnight. Conversion was determined via LC-MS (0.25M $NH_4 HCO_3:H_2O$ buffer system). Celite® was added to the reaction mixture and it was concentrated under vacuum until a white powder remained. The mixture was loaded dry onto a silica column (12 gram) using a s EtOAc/Hexanes (1% Triethylamine) solvent system to prevent hydrolysis from the silica gel. The desired product was not retained on the column and came out shortly after being loaded. The isolated product was then characterized by LC-MS, $^1$HNMR and $^{31}$PNMR. Final yield: 856.5 mg (93.8%).

Synthesis of C22 phosporamidite

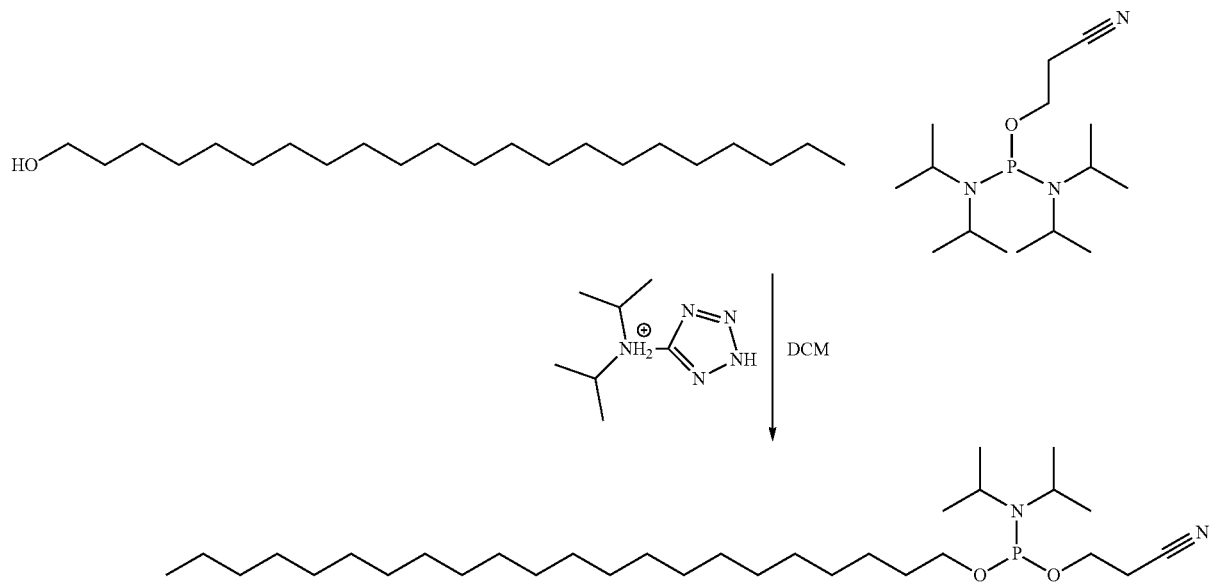

Docosanol (1.10 g), Bis(diisopropylamino)(2-cyanoethoxy)phosphine (2.1 mL) and BisDiisopropylammonium tetrazolide (0.577 g) were dissolved in a solution of DCM at room temperature. The reaction was capped and stirred overnight. Conversion was determined via LC-MS (0.25M $NH_4 HCO_3:H_2O$ buffer system). Celite® was added to the reaction mixture and it was concentrated under vacuum until a white powder remained. The mixture was loaded dry onto a silica column (12 gram) pretreated with 3 mL of triethylamine using a EtOAc/Hexanes (1% Triethylamine) solvent system to prevent hydrolysis from the silica gel. The isolated product was then characterized by LC-MS, $^1$HNMR and $^{31}$PNMR. Final yield: 2.1085 g (118.8%).

Conjugation of Lipid PK/PD Modulator Precursors

Either prior to or after annealing, one or more lipid PK/PD modulator precursors can be linked to the RNAi agents disclosed herein. The following describes the general conjugation process used to link lipid PK/PD modulator precursors to the constructs set forth in the Examples depicted herein.

A. Conjugation of Activated Ester PK/PD Modulators

The following procedure was used to conjugate PK/PD modulators having an activated ester moiety such as TFP (tetrafluorophenoxy) or PNP (para-nitrophenol) to an RNAi agent with an amine-functionalized sense strand, such as C6-NH2, NH2-C6, or (NH2-C6). An annealed RNAi Agent dried by lyophilization was dissolved in DMSO and 10% water (v/v %) at 25 mg/mL. Then 50-100 equivalents of TEA and 3 equivalents of activated ester PK/PD modulator were added to the solution. The solution was allowed to react for 1-2 hours, while monitored by RP-HPLC-MS (mobile phase A 100 mM HFIP, 14 mM TEA; mobile phase B: acetonitrile on an Waters™ XBridge C18 column, Waters Corp.)

The product was then precipitated by adding 12 mL acetonitrile and 0.4 mL PBS and centrifuging the solid to a pellet. The pellet was then re-dissolved in 0.4 mL of 1XPBS and 12 mL of acetonitrile. The resulting pellet was dried on high vacuum for one hour.

B. Conjugation of Phosphoramidite PK/PD Modulators

PK/PD modulators having a phosphoramidite moiety may be attached on resin using typical oligonucleotide manufacturing conditions.

C. Hydrolysis of PK/PD Modulators

Certain PK/PD modulators are hydrolyzed in the cleavage and deprotection conditions described in Example 1, above. For example LP-429p, LP-456p, LP-462p, LP-463p, LP-464p, LP-466p, LP-493p, and HO—C16 phosphoramidite all include moieties that are hydrolyzed under the cleavage and deprotection conditions.

LP-465p is hydrolyzed following conjugation to the oligonucleotide strand in a solution of 0.5-1 M potassium carbonate in 1:1 methanol to water and heated to 50-60° C. for about 4 hours.

Example 2. In Vivo Knockdown of SOD1 in Transgenic B6·Cg-Tg (SOD1*G93A) Mice

On Study day 1, B6·Cg-Tg(SOD1*G93A) mice were injected with either 10 µL Phosphate buffered saline (PBS) or 10 µL of compound formulation at a concentration of 5 mg/mL in PBS for groups 2, 4, and 6 or 20 mg/mL in PBS for groups 3, 5, and 7, according to Table 12 below:

TABLE 12

Dosing groups for the mice of Example 2.

| Group ID | Animals dosed | AC Duplex Number |
|---|---|---|
| Group 1 (PBS) | n = 4 | N/A |
| Group 2 (50 µg LP183-AD09385) | n = 4 | AC001455 |
| Group 3 (200 µg LP183-AD09385) | n = 4 | AC001455 |
| Group 4 (50 µg LP183-AD09395) | n = 4 | AC001465 |
| Group 5 (200 µg LP183-AD09395) | n = 4 | AC001465 |
| Group 6 (50 µg LP183-AD09401) | n = 4 | AC001471 |
| Group 7 (200 µg LP183-AD09401) | n = 4 | AC001471 |

Four (n=4) mice were dosed in each group. Mice were injected intracerebroventricularly on day 1. On day 12, mice were euthanized and the left half of the brain and thoracic spinal cord were collected and stored in 10% NBF. Tissue samples were taken from the thoracic spinal cord, cortex, cerebellum and brain stem. Samples were analyzed by qPCR for SOD1 mRNA knockdown. Average results for each group are shown in Table 13 below:

TABLE 13

Relative expression of SOD1 mRNA in various tissues analyzed by qPCR for each of the dosing groups of Example 2.

| | | Cortex | | | Cerebellum | | |
| | | Group Average (n = 4) | | | Group Average (n = 4) | | |
| Group # | Description | Rel. Exp. | Error (Low) | Error (High) | Rel. Exp. | Error (Low) | Error (High) |
|---|---|---|---|---|---|---|---|
| 1 | PBS | 1.000 | 0.075 | 0.081 | 1.000 | 0.076 | 0.082 |
| 2 | 50 µg AC001455 | 0.926 | 0.044 | 0.046 | 0.524 | 0.029 | 0.031 |
| 3 | 200 µg AC001455 | 0.754 | 0.124 | 0.148 | 0.226 | 0.024 | 0.027 |
| 4 | 50 µg AC001465 | 1.043 | 0.136 | 0.156 | 0.685 | 0.099 | 0.116 |
| 5 | 200 µg AC001465 | 0.689 | 0.112 | 0.133 | 0.359 | 0.049 | 0.057 |
| 6 | 50 µg AC001471 | 0.958 | 0.049 | 0.052 | 0.964 | 0.088 | 0.096 |
| 7 | 200 µg AC001471 | 0.981 | 0.092 | 0.101 | 0.672 | 0.054 | 0.059 |

| | | Thoracic Spinal Cord | | | Brainstem | | |
| | | Group Average (n = 4) | | | Group Average (n = 4) | | |
| Group # | Description | Rel. Exp. | Error (Low) | Error (High) | Rel. Exp. | Error (Low) | Error (High) |
|---|---|---|---|---|---|---|---|
| 1 | PBS | 1.000 | 0.094 | 0.104 | 1.000 | 0.075 | 0.081 |
| 2 | 50 ug AC001455 | 0.575 | 0.071 | 0.080 | 0.926 | 0.044 | 0.046 |
| 3 | 200 ug AC001455 | 0.220 | 0.012 | 0.013 | 0.754 | 0.124 | 0.148 |
| 4 | 50 ug AC001465 | 0.628 | 0.105 | 0.127 | 1.043 | 0.136 | 0.156 |
| 5 | 200 ug AC001465 | 0.259 | 0.037 | 0.043 | 0.689 | 0.112 | 0.133 |
| 6 | 50 ug AC001471 | 0.923 | 0.036 | 0.038 | 0.958 | 0.049 | 0.052 |
| 7 | 200 ug AC001471 | 0.724 | 0.033 | 0.035 | 0.905 | 0.075 | 0.081 |

As shown in Table 13, SOD1 RNAi agents AC001455 and AC001465 showed dose-dependent improvements in mRNA knockdown over the PBS-administered group in every tissue analyzed.

Example 3. In Vivo Knockdown of SOD1 in Transgenic B6·Cg-Tg(SOD1*G93A) Mice

On Study day 1, B6·Cg-Tg(SOD1*G93A) mice were injected with either 10 µL artificial cerebrospinal fluid (aCSF, obtained from a commercial supplier) or 10 µL of compound formulation at a concentration of 7 mg/mL in aCSF, according to Table 14 below:

TABLE 14

Dosing groups for the mice of Example 3.

| Group ID | Animals dosed | AC Duplex Number |
|---|---|---|
| Group 1 (aCSF) | n = 3 | N/A |
| Group 2 (70 µg LP183-AD09381) | n = 3 | AC001451 |
| Group 3 (70 µg LP183-AD09382) | n = 3 | AC001452 |
| Group 4 (70 µg LP183-AD09384) | n = 3 | AC001454 |
| Group 5 (70 µg LP183-AD09385) | n = 3 | AC001455 |
| Group 6 (70 µg LP183-AD09386) | n = 3 | AC001456 |
| Group 7 (70 µg LP183-AD09388) | n = 3 | AC001458 |
| Group 8 (70 µg LP183-AD09389) | n = 3 | AC001459 |

TABLE 14-continued

Dosing groups for the mice of Example 3.

| Group ID | Animals dosed | AC Duplex Number |
|---|---|---|
| Group 9 (70 µg LP183-AD09390) | n = 3 | AC001460 |
| Group 10 (70 µg LP183-AD09391) | n = 3 | AC001461 |
| Group 11 (70 µg LP183-AD09392) | n = 3 | AC001462 |
| Group 12 (70 µg LP183-AD09393) | n = 3 | AC001463 |
| Group 13 (70 µg LP183-AD09396) | n = 3 | AC001466 |
| Group 14 (70 µg LP183-AD09397) | n = 3 | AC001467 |
| Group 15 (70 µg LP183-AD09400) | n = 3 | AC001470 |
| Group 16 (70 µg LP183-AD09401) | n = 3 | AC001471 |
| Group 17 (70 µg LP183-AD09402) | n = 3 | AC001472 |
| Group 18 (70 µg LP183-AD09403) | n = 3 | AC001473 |

Mice were injected intracerebroventricularly on day 1. On day 12, mice were euthanized and the left half of the brain and thoracic spinal cord were collected and stored in 10% NBF. Tissue samples were taken from the thoracic spinal cord, cortex, cerebellum and brain stem. Samples were analyzed by qPCR for SOD1 mRNA knockdown. Average results for each group in the thoracic spinal cord are shown in Table 15 below:

TABLE 15

Relative expression of mRNA SOD1 in mice thoracic spinal cord analyzed by qPCR for each of the dosing groups of Example 3.

| | | | | hSOD1 Individual | | |
|---|---|---|---|---|---|---|
| Group # | Description | | Group # | Rel. Exp. | Error (Low) | Error (High) |
| 1 | aCSF | n = 3 | 1 | 1.000 | 0.122 | 0.139 |
| 2 | 70 ug AC001451 | n = 3 | 2 | 1.162 | 0.091 | 0.099 |
| 3 | 70 ug AC001452 | n = 3 | 3 | 1.179 | 0.123 | 0.138 |
| 4 | 70 ug AC001454 | n = 3 | 4 | 1.202 | 0.102 | 0.112 |
| 5 | 70 ug AC001455 | n = 3 | 5 | 0.680 | 0.095 | 0.111 |
| 6 | 70 ug AC001456 | n = 3 | 6 | 1.106 | 0.062 | 0.066 |
| 7 | 70 ug AC001458 | n = 3 | 7 | 1.178 | 0.078 | 0.084 |
| 8 | 70 ug AC001459 | n = 3 | 8 | 1.018 | 0.061 | 0.065 |
| 9 | 70 ug AC001460 | n = 3 | 9 | 1.122 | 0.098 | 0.107 |
| 10 | 70 ug AC001461 | n = 3 | 10 | 0.643 | 0.076 | 0.087 |
| 11 | 70 ug AC001462 | n = 3 | 11 | 0.861 | 0.067 | 0.072 |
| 12 | 70 ug AC001463 | n = 3 | 12 | 0.907 | 0.131 | 0.152 |
| 13 | 70 ug AC001466 | n = 3 | 13 | 0.781 | 0.059 | 0.064 |
| 14 | 70 ug AC001467 | n = 3 | 14 | 0.902 | 0.080 | 0.088 |
| 15 | 70 ug AC001470 | n = 3 | 15 | 1.091 | 0.085 | 0.092 |
| 16 | 70 ug AC001471 | n = 3 | 16 | 1.000 | 0.085 | 0.093 |
| 17 | 70 ug AC001472 | n = 3 | 17 | 1.018 | 0.051 | 0.053 |
| 18 | 70 ug AC001473 | n = 3 | 18 | 0.964 | 0.046 | 0.048 |

As shown in Table 15, a few dosing groups showed notable improvement in mRNA knockdown over the aCSF-administered group. For example, SOD1 RNAi agent AC011445 showed a reduction of approximately 32% (0.680) and SOD1 RNAi agent AD001461 showed a reduction of approximately 35% o (0.643).

Example 4. In Vivo Knockdown of SOD1 in Transgenic Tg SOD1 G93A Mice

On Study day 1, Tg SOD1 G93A mice were injected with either 10 µL artificial cerebrospinal fluid (aCSF, obtained from a commercial supplier) or 10 µL of compound formulation at a concentration of 10 mg/mL in aCSF according to Table 16 below:

TABLE 16

Dosing groups for the mice of Example 4.

| Group ID | Animals dosed | AC Duplex Number |
|---|---|---|
| Group 1 (aCSF) | n = 3 | N/A |
| Group 2 (100 µg LP183-AD09385) | n = 3 | AC001455 |
| Group 3 (100 µg LP183-AD09391) | n = 3 | AC001461 |
| Group 4 (100 µg LP183-AD09756) | n = 3 | AC001623 |
| Group 5 (100 µg LP183-AD09757) | n = 3 | AC001624 |
| Group 6 (100 µg LP183-AD09758) | n = 3 | AC001625 |
| Group 7 (100 µg LP183-AD09760) | n = 3 | AC001627 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 17 below:

TABLE 17

Relative expression of SOD1 mRNA in various tissues analyzed by qPCR for each of the dosing groups of Example 4.

| | | Cortex | | | Cerebellum | | |
|---|---|---|---|---|---|---|---|
| | | Group Average (n = 3) | | | Group Average (n = 3) | | |
| Group # | Description | Rel. Exp. | Error (Low) | Error (High) | Rel. Exp. | Error (Low) | Error (High) |
| 1 | aCSF | 1.000 | 0.087 | 0.095 | 1.000 | 0.095 | 0.105 |
| 2 | 100 ug AC001455 | 0.740 | 0.128 | 0.155 | 0.264 | 0.059 | 0.075 |
| 3 | 100 ug AC001461 | 0.798 | 0.040 | 0.042 | 0.237 | 0.039 | 0.046 |
| 4 | 100 ug AC001623 | 0.792 | 0.099 | 0.113 | 0.577 | 0.035 | 0.037 |
| 5 | 100 ug AC001624 | 0.859 | 0.126 | 0.147 | 0.695 | 0.067 | 0.074 |
| 6 | 100 ug AC001625 | 0.823 | 0.166 | 0.208 | 0.858 | 0.065 | 0.071 |
| 7 | 100 ug AC001627 | 0.934 | 0.172 | 0.211 | 0.735 | 0.058 | 0.063 |

| | | Thoracic Spinal Cord | | | Brainstem | | |
|---|---|---|---|---|---|---|---|
| | | Group Average (n = 3) | | | Group Average (n = 3) | | |
| Group # | Description | Rel. Exp. | Error (Low) | Error (High) | Rel. Exp. | Error (Low) | Error (High) |
| 1 | aCSF | 1.000 | 0.169 | 0.203 | 1.000 | 0.196 | 0.244 |
| 2 | 100 ug AC001455 | 0.532 | 0.048 | 0.053 | 0.544 | 0.055 | 0.061 |
| 3 | 100 ug AC001461 | 0.504 | 0.044 | 0.049 | 0.576 | 0.080 | 0.093 |
| 4 | 100 ug AC001623 | 0.412 | 0.151 | 0.239 | 0.760 | 0.138 | 0.169 |
| 5 | 100 ug AC001624 | 0.735 | 0.054 | 0.058 | 0.848 | 0.111 | 0.128 |
| 6 | 100 ug AC001625 | 0.705 | 0.117 | 0.140 | 0.759 | 0.147 | 0.182 |
| 7 | 100 ug AC001627 | 0.694 | 0.067 | 0.074 | 0.885 | 0.070 | 0.076 |

As shown in Table 17, every dosing group showed numerical improvement in mRNA knockdown over the aCSF-administered group in every tissue analyzed, with AC001455, AC001461 and AC001623 showing particularly robust inhibition across several different tissue types.

Example 5. In Vivo Knockdown of SOD1 in Transgenic Tg SOD1 G93A Mice

On Study day 1, Tg SOD1 G93A mice were injected with either 10 µL artificial cerebrospinal fluid (aCSF, obtained from a commercial supplier) or 10 µL of compound formulation at a concentration of 10 mg/mL in aCSF according to Table 18 below:

TABLE 18

Dosing groups for the mice of Example 5.

| Group ID | Animals dosed | AC Duplex Number |
|---|---|---|
| Group 1 (aCSF) | n = 3 | N/A |
| Group 2 (100 μg LP183-AD09385) | n = 3 | AC001455 |
| Group 3 (100 μg LP183-AD10055) | n = 3 | AC001809 |
| Group 4 (100 μg LP183-AD10056) | n = 3 | AC001810 |
| Group 5 (100 μg LP183-AD10057) | n = 3 | AC001811 |
| Group 6 (100 μg LP183-AD10058) | n = 3 | AC001812 |
| Group 7 (100 μg LP183-AD10059) | n = 3 | AC001813 |
| Group 8 (100 μg LP183-AD10061) | n = 3 | AC001814 |
| Group 9 (100 μg LP183-AD10066) | n = 3 | AC001815 |
| Group 10 (100 μg LP183-AD10067) | n = 3 | AC001816 |
| Group 11 (100 μg LP183-AD10068) | n = 3 | AC001817 |
| Group 12 (100 μg LP183-AD10069) | n = 3 | AC001818 |
| Group 13 (100 μg LP183-AD10070) | n = 3 | AC001819 |
| Group 14 (100 μg LP183-AD10071) | n = 3 | AC001820 |
| Group 15 (100 μg LP183-AD10072) | n = 3 | AC001821 |
| Group 16 (100 μg LP183-AD10073) | n = 3 | AC001822 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 19 below:

TABLE 19

Relative expression of SOD1 mRNA in various tissues analyzed by qPCR for each of the dosing groups of Example 5.

| | | Cortex Group Average (n = 3) | | | Cerebellum Group Average (n = 3) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.090 | 0.099 | 1.000 | 0.079 | 0.085 |
| 2 | 100 μg AC001455 | 0.892 | 0.115 | 0.132 | 0.340 | 0.051 | 0.060 |
| 3 | 100 μg AC001809 | 0.851 | 0.169 | 0.212 | 0.365 | 0.048 | 0.055 |
| 4 | 100 μg AC001810 | 0.910 | 0.094 | 0.104 | 0.381 | 0.089 | 0.116 |
| 5 | 100 μg AC001811 | 0.816 | 0.039 | 0.041 | 0.434 | 0.096 | 0.124 |
| 6 | 100 μg AC001812 | 0.553 | 0.158 | 0.221 | 0.547 | 0.125 | 0.162 |
| 7 | 100 μg AC001813 | 0.400 | 0.054 | 0.063 | 0.178 | 0.013 | 0.014 |
| 8 | 100 μg AC001814 | 0.578 | 0.141 | 0.186 | 0.181 | 0.017 | 0.019 |
| 9 | 100 μg AC001815 | 0.916 | 0.102 | 0.115 | 0.374 | 0.054 | 0.063 |
| 10 | 100 μg AC001816 | 0.925 | 0.074 | 0.080 | 0.486 | 0.058 | 0.066 |
| 11 | 100 μg AC001817 | 0.347 | 0.115 | 0.172 | 0.249 | 0.082 | 0.122 |
| 12 | 100 μg AC001818 | 0.391 | 0.083 | 0.105 | 0.144 | 0.037 | 0.051 |
| 13 | 100 μg AC001819 | 0.399 | 0.051 | 0.059 | 0.286 | 0.111 | 0.182 |
| 14 | 100 μg AC001820 | 0.630 | 0.110 | 0.133 | 0.189 | 0.055 | 0.078 |
| 15 | 100 μg AC001821 | 0.670 | 0.050 | 0.054 | 0.202 | 0.016 | 0.018 |
| 16 | 100 μg AC001822 | 0.466 | 0.113 | 0.150 | 0.224 | 0.060 | 0.082 |

| | | Thoracic Spinal Cord Group Average (n = 3) | | | Brainstem Group Average (n = 3) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.080 | 0.087 | 1.000 | 0.084 | 0.092 |
| 2 | 100 μg AC001455 | 0.354 | 0.029 | 0.032 | 0.587 | 0.045 | 0.049 |
| 3 | 100 μg AC001809 | 0.404 | 0.032 | 0.035 | 0.653 | 0.098 | 0.116 |
| 4 | 100 μg AC001810 | 0.338 | 0.057 | 0.069 | 0.637 | 0.074 | 0.083 |
| 5 | 100 μg AC001811 | 0.406 | 0.092 | 0.120 | 0.806 | 0.083 | 0.092 |
| 6 | 100 μg AC001812 | 0.436 | 0.098 | 0.127 | 0.610 | 0.082 | 0.095 |
| 7 | 100 μg AC001813 | 0.090 | 0.008 | 0.008 | 0.262 | 0.064 | 0.085 |
| 8 | 100 μg AC001814 | 0.057 | 0.007 | 0.008 | 0.206 | 0.025 | 0.028 |
| 9 | 100 μg AC001815 | 0.230 | 0.053 | 0.070 | 0.441 | 0.039 | 0.043 |
| 10 | 100 μg AC001816 | 0.530 | 0.052 | 0.057 | 0.870 | 0.084 | 0.093 |
| 11 | 100 μg AC001817 | 0.168 | 0.044 | 0.060 | 0.329 | 0.088 | 0.120 |
| 12 | 100 μg AC001818 | 0.075 | 0.008 | 0.009 | 0.128 | 0.013 | 0.015 |
| 13 | 100 μg AC001819 | 0.112 | 0.019 | 0.023 | 0.282 | 0.022 | 0.024 |
| 14 | 100 μg AC001820 | 0.089 | 0.020 | 0.025 | 0.229 | 0.044 | 0.055 |
| 15 | 100 μg AC001821 | 0.079 | 0.028 | 0.044 | 0.212 | 0.036 | 0.043 |
| 16 | 100 μg AC001822 | 0.114 | 0.014 | 0.015 | 0.259 | 0.057 | 0.073 |

As shown in Table 19, every dosing group showed numerical improvement in mRNA knockdown over the aCSF-administered group in every tissue analyzed. Notable, AC001813, AC001814, and AC001818 showed particularly potent inhibition of SOD1 gene expression across all examined tissues.

Example 6. In Vivo Knockdown of SOD1 in Transgenic Tg SOD1 G93A Mice

On Study day 1, Tg SOD1 G93A mice were injected with either 10 μL artificial cerebrospinal fluid (aCSF, obtained from a commercial supplier) or 10 μL of compound formulation at a concentration of 10 mg/mL in aCSF according to Table 20 below:

TABLE 20

Dosing groups for the mice of Example 6.

| Group ID | Animals dosed | AC Duplex Number |
|---|---|---|
| Group 1 (aCSF) | n = 3 | N/A |
| Group 2 (100 μg LP183-AD09391) | n = 3 | AC001461 |
| Group 3 (100 μg LP183-AD10077) | n = 3 | AC001801 |
| Group 4 (100 μg LP183-AD10078) | n = 3 | AC001802 |
| Group 5 (100 μg LP183-AD10079) | n = 3 | AC001803 |
| Group 6 (100 μg LP183-AD10080) | n = 3 | AC001804 |
| Group 7 (100 μg LP183-AD10081) | n = 3 | AC001805 |
| Group 8 (100 μg LP183-AD10082) | n = 3 | AC001806 |
| Group 9 (100 μg LP183-AD10083) | n = 3 | AC001807 |
| Group 10 (100 μg LP183-AD10084) | n = 3 | AC001808 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 21 below:

TABLE 21

Relative expression of SOD1 mRNA in various tissues analyzed by qPCR for each of the dosing groups of Example 6.

| | | Cortex Group Average (n = 3) | | | Cerebellum Group Average (n = 3) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.148 | 0.174 | 1.000 | 0.074 | 0.080 |
| 2 | 100 μg AC001461 | 1.013 | 0.074 | 0.080 | 0.511 | 0.047 | 0.052 |
| 3 | 100 μg AC001801 | 0.899 | 0.151 | 0.181 | 0.641 | 0.105 | 0.126 |
| 4 | 100 μg AC001802 | 1.008 | 0.097 | 0.108 | 0.585 | 0.054 | 0.060 |

TABLE 21-continued

Relative expression of SOD1 mRNA in various tissues analyzed by qPCR for each of the dosing groups of Example 6.

| 5 | 100 µg AC001803 | 1.006 | 0.097 | 0.107 | 0.673 | 0.037 | 0.039 |
| 6 | 100 µg AC001804 | 1.057 | 0.132 | 0.151 | 0.758 | 0.112 | 0.132 |
| 7 | 100 µg AC001805 | 0.962 | 0.089 | 0.098 | 0.728 | 0.122 | 0.146 |
| 8 | 100 µg AC001806 | 0.435 | 0.183 | 0.315 | 0.602 | 0.085 | 0.098 |
| 9 | 100 µg AC001807 | 0.504 | 0.273 | 0.595 | 0.572 | 0.036 | 0.039 |
| 10 | 100 µg AC001808 | 0.516 | 0.257 | 0.511 | 0.588 | 0.070 | 0.080 |

| | | Thoracic Spinal Cord | | | Brainstem | | |
| | | Group Average (n = 3) | | | Group Average (n = 3) | | |
| Group # | Description | Rel. Exp. | Error (Low) | Error (High) | Rel. Exp. | Error (Low) | Error (High) |
| --- | --- | --- | --- | --- | --- | --- | --- |
| 1 | aCSF | 1.000 | 0.151 | 0.178 | 1.000 | 0.088 | 0.097 |
| 2 | 100 µg AC001461 | 0.378 | 0.063 | 0.075 | 0.591 | 0.100 | 0.120 |
| 3 | 100 µg AC001801 | 0.448 | 0.121 | 0.165 | 0.538 | 0.072 | 0.083 |
| 4 | 100 µg AC001802 | 0.445 | 0.100 | 0.128 | 0.604 | 0.062 | 0.069 |
| 5 | 100 µg AC001803 | 0.761 | 0.129 | 0.156 | 0.679 | 0.115 | 0.139 |
| 6 | 100 µg AC001804 | 0.510 | 0.038 | 0.041 | 0.715 | 0.138 | 0.170 |
| 7 | 100 µg AC001805 | 0.265 | 0.078 | 0.111 | 0.525 | 0.061 | 0.069 |
| 8 | 100 µg AC001806 | 0.140 | 0.045 | 0.066 | 0.259 | 0.049 | 0.061 |
| 9 | 100 µg AC001807 | 0.077 | 0.021 | 0.028 | 0.310 | 0.044 | 0.051 |
| 10 | 100 µg AC001808 | 0.175 | 0.046 | 0.063 | 0.362 | 0.042 | 0.047 |

As shown in Table 21, almost every dosing group showed improvement in mRNA knockdown over the aCSF-administered group in most of the tissues analyzed.

Example 7. In Vivo Knockdown of SOD1 in Transgenic TgSOD1 G93A Mice

On Study day 1, Tg SOD1 G93A mice were injected with either 10 µL artificial cerebrospinal fluid (aCSF, obtained from a commercial supplier) or 10 µL of compound formulation at a concentration of 5 mg/mL in aCSF according to Table 22 below:

TABLE 22

Dosing groups for the mice of Example 7.

| Group ID | Animals dosed | AC Duplex Number |
| --- | --- | --- |
| Group 1 (aCSF) | n = 4 | N/A |
| Group 2 (50 µg LP183-AD10069) | n = 4 | AC001818 |
| Group 3 (50 µg LP183-AD10564) | n = 4 | AC002111 |
| Group 4 (50 µg LP183-AD10565) | n = 4 | AC002112 |
| Group 5 (50 µg LP183-AD10566) | n = 4 | AC002113 |
| Group 6 (50 µg LP183-AD10567) | n = 4 | AC002114 |
| Group 7 (50 µg LP183-AD10568) | n = 4 | AC002115 |
| Group 8 (50 µg LP183-AD10569) | n = 4 | AC002116 |
| Group 9 (50 µg LP183-AD10570) | n = 4 | AC002117 |
| Group 10 (50 µg LP183-AD10571) | n = 4 | AC002118 |
| Group 11 (50 µg LP183-AD10572) | n = 4 | AC002119 |
| Group 12 (50 µg LP310-AD10069) | n = 4 | AC002101 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 23 below:

TABLE 23

Relative expression of SOD1 mRNA in various tissues analyzed by qPCR for each of the dosing groups of Example 7.

| | | Cortex | | | Cerebellum | | |
| | | Group Average (n = 4) | | | Group Average (n = 4) | | |
| Group # | Description | Rel. Exp. | Error (Low) | Error (High) | Rel. Exp. | Error (Low) | Error (High) |
| --- | --- | --- | --- | --- | --- | --- | --- |
| 1 | aCSF | 1.000 | 0.088 | 0.097 | 1.000 | 0.092 | 0.102 |
| 2 | 50 µg AC001818 | 0.524 | 0.092 | 0.112 | 0.223 | 0.018 | 0.020 |
| 3 | 50 µg AC002111 | 0.446 | 0.112 | 0.149 | 0.185 | 0.032 | 0.038 |
| 4 | 50 µg AC002112 | 0.625 | 0.086 | 0.100 | 0.272 | 0.054 | 0.067 |
| 5 | 50 µg AC002113 | 0.784 | 0.070 | 0.077 | 0.332 | 0.057 | 0.069 |
| 6 | 50 µg AC002114 | 0.561 | 0.197 | 0.304 | 0.266 | 0.037 | 0.043 |
| 7 | 50 µg AC002115 | 0.542 | 0.067 | 0.076 | 0.301 | 0.049 | 0.059 |
| 8 | 50 µg AC002116 | 0.412 | 0.096 | 0.125 | 0.229 | 0.029 | 0.033 |
| 9 | 50 µg AC002117 | 0.526 | 0.059 | 0.067 | 0.220 | 0.025 | 0.028 |
| 10 | 50 µg AC002118 | 0.522 | 0.053 | 0.059 | 0.243 | 0.023 | 0.025 |
| 11 | 50 µg AC002119 | 0.487 | 0.124 | 0.166 | 0.228 | 0.035 | 0.042 |
| 12 | 50 µg AC002101 | 0.533 | 0.080 | 0.095 | 0.323 | 0.044 | 0.051 |

| | | Thoracic Spinal Cord | | | Brainstem | | |
| | | Group Average (n = 4) | | | Group Average (n = 4) | | |
| Group # | Description | Rel. Exp. | Error (Low) | Error (High) | Rel. Exp. | Error (Low) | Error (High) |
| --- | --- | --- | --- | --- | --- | --- | --- |
| 1 | aCSF | 1.000 | 0.073 | 0.078 | 1.000 | 0.082 | 0.090 |
| 2 | 50 µg AC001818 | 0.077 | 0.014 | 0.017 | 0.134 | 0.025 | 0.030 |
| 3 | 50 µg AC002111 | 0.102 | 0.043 | 0.075 | 0.181 | 0.023 | 0.026 |
| 4 | 50 µg AC002112 | 0.107 | 0.039 | 0.062 | 0.333 | 0.070 | 0.088 |
| 5 | 50 µg AC002113 | 0.156 | 0.065 | 0.112 | 0.310 | 0.075 | 0.098 |
| 6 | 50 µg AC002114 | 0.105 | 0.038 | 0.060 | 0.246 | 0.034 | 0.039 |
| 7 | 50 µg AC002115 | 0.109 | 0.019 | 0.023 | 0.331 | 0.036 | 0.040 |
| 8 | 50 µg AC002116 | 0.075 | 0.016 | 0.021 | 0.243 | 0.045 | 0.056 |
| 9 | 50 µg AC002117 | 0.089 | 0.023 | 0.031 | 0.214 | 0.020 | 0.022 |
| 10 | 50 µg AC002118 | 0.098 | 0.036 | 0.058 | 0.255 | 0.028 | 0.031 |
| 11 | 50 µg AC002119 | 0.107 | 0.026 | 0.035 | 0.230 | 0.024 | 0.026 |
| 12 | 50 µg AC002101 | 0.205 | 0.028 | 0.032 | 0.369 | 0.035 | 0.038 |

As shown in Table 23, every dosing group showed improvement in mRNA knockdown over the aCSF-administered group in every tissue analyzed.

Example 8. In Vivo Knockdown of SOD1 in Transgenic Tg SOD1 G93A Mice

On Study day 1, Tg SOD1 G93A mice were injected with either 10 µL artificial cerebrospinal fluid (aCSF, obtained from a commercial supplier) or 10 µL of compound formulation at a concentration of 5 mg/mL in aCSF according to Table 24 below:

TABLE 24

Dosing groups for the mice of Example 8.

| Group ID | Animals dosed | AC Duplex Number |
| --- | --- | --- |
| Group 1 (aCSF) | n = 4 | N/A |
| Group 2 (50 µg LP183-AD10082) | n = 4 | AC001806 |
| Group 3 (50 µg LP183-AD10083) | n = 4 | AC001807 |
| Group 4 (50 µg LP183-AD10573) | n = 4 | AC002102 |
| Group 5 (50 µg LP183-AD10574) | n = 4 | AC002103 |
| Group 6 (50 µg LP183-AD10575) | n = 4 | AC002104 |
| Group 7 (50 µg LP183-AD10576) | n = 4 | AC002105 |
| Group 8 (50 µg LP183-AD10577) | n = 4 | AC002106 |
| Group 9 (50 µg LP183-AD10578) | n = 4 | AC002107 |

TABLE 24-continued

Dosing groups for the mice of Example 8.

| Group ID | Animals dosed | AC Duplex Number |
|---|---|---|
| Group 10 (50 µg LP183-AD10579) | n = 4 | AC002108 |
| Group 11 (50 µg LP183-AD10580) | n = 4 | AC002109 |
| Group 12 (50 µg LP183-AD10581) | n = 4 | AC002110 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 25 below:

TABLE 25

Relative expression of SOD1 mRNA in various tissues analyzed by qPCR for each of the dosing groups of Example 8.

| | | Cortex | | | Thoracic Spinal Cord | | |
|---|---|---|---|---|---|---|---|
| | | Group Average (n = 4) | | | Group Average (n = 4) | | |
| Group # | Description | Rel. Exp. | Error (Low) | Error (High) | Rel. Exp. | Error (Low) | Error (High) |
| 1 | aCSF | 1.000 | 0.088 | 0.096 | 1.000 | 0.092 | 0.102 |
| 2 | 50 µg AC001806 | 0.740 | 0.132 | 0.161 | 0.267 | 0.026 | 0.028 |
| 3 | 50 µg AC001807 | 0.712 | 0.087 | 0.099 | 0.316 | 0.119 | 0.191 |
| 4 | 50 µg AC002102 | 0.866 | 0.093 | 0.105 | 0.341 | 0.088 | 0.118 |
| 5 | 50 µg AC002103 | 1.049 | 0.076 | 0.082 | 0.507 | 0.137 | 0.187 |
| 6 | 50 µg AC002104 | 0.907 | 0.114 | 0.131 | 0.317 | 0.026 | 0.029 |
| 7 | 50 µg AC002105 | 1.084 | 0.049 | 0.052 | 0.282 | 0.070 | 0.093 |
| 8 | 50 µg AC002106 | 1.203 | 0.151 | 0.173 | 0.314 | 0.050 | 0.060 |
| 9 | 50 µg AC002107 | 1.181 | 0.245 | 0.309 | 0.477 | 0.112 | 0.147 |
| 10 | 50 µg AC002108 | 0.973 | 0.213 | 0.273 | 0.265 | 0.071 | 0.097 |
| 11 | 50 µg AC002109 | 0.884 | 0.196 | 0.252 | 0.346 | 0.060 | 0.073 |
| 12 | 50 µg AC002110 | 1.149 | 0.152 | 0.175 | 0.474 | 0.100 | 0.127 |

| | | Cerebellum | | | Brainstem | | |
|---|---|---|---|---|---|---|---|
| | | Group Average (n = 4) | | | Group Average (n = 4) | | |
| Group # | Description | Rel. Exp. | Error (Low) | Error (High) | Rel. Exp. | Error (Low) | Error (High) |
| 1 | aCSF | 1.000 | 0.093 | 0.102 | 1.000 | 0.080 | 0.087 |
| 2 | 50 µg AC001806 | 0.506 | 0.057 | 0.065 | 0.351 | 0.047 | 0.054 |
| 3 | 50 µg AC001807 | 0.519 | 0.078 | 0.092 | 0.406 | 0.056 | 0.065 |
| 4 | 50 µg AC002102 | 0.481 | 0.038 | 0.041 | 0.403 | 0.046 | 0.052 |
| 5 | 50 µg AC002103 | 0.706 | 0.097 | 0.112 | 0.567 | 0.075 | 0.086 |
| 6 | 50 µg AC002104 | 0.598 | 0.083 | 0.096 | 0.580 | 0.071 | 0.081 |
| 7 | 50 µg AC002105 | 0.673 | 0.071 | 0.079 | 0.428 | 0.065 | 0.076 |
| 8 | 50 µg AC002106 | 0.590 | 0.041 | 0.045 | 0.488 | 0.082 | 0.098 |
| 9 | 50 µg AC002107 | 0.619 | 0.075 | 0.086 | 0.671 | 0.070 | 0.078 |
| 10 | 50 µg AC002108 | 0.514 | 0.053 | 0.059 | 0.396 | 0.067 | 0.080 |
| 11 | 50 µg AC002109 | 0.497 | 0.088 | 0.108 | 0.452 | 0.080 | 0.097 |
| 12 | 50 µg AC002110 | 0.688 | 0.071 | 0.080 | 0.653 | 0.102 | 0.122 |

As shown in Table 25, every dosing group showed improvement in mRNA knockdown over the aCSF-administered group in the thoracic spinal cord, cerebellum, and the brainstem.

Example 9. In Vivo Knockdown of SOD1 in Transgenic Tg SOD1 G93A Mice

On Study day 1, Tg SOD1 G93A mice were injected with either 10 µL artificial cerebrospinal fluid (aCSF, obtained from a commercial supplier) or 10 µL of compound formulation at a concentration of 3 mg/mL in aCSF according to Table 26 below:

TABLE 26

Dosing groups for the mice of Example 9.

| Group ID | Animals dosed | AD Duplex Number |
|---|---|---|
| Group 1 (aCSF) | n = 3 | N/A |
| Group 2 (30 µg LP183-AD11196) | n = 3 | AD11196 |
| Group 3 (30 µg LP183-AD11384) | n = 3 | AD11384 |
| Group 4 (30 µg LP183-AD11385) | n = 3 | AD11385 |
| Group 5 (30 µg LP183-AD11386) | n = 3 | AD11386 |
| Group 6 (30 µg LP183-AD11387) | n = 3 | AD11387 |
| Group 7 (30 µg LP183-AD11388) | n = 3 | AD11388 |
| Group 8 (30 µg LP183-AD11389) | n = 3 | AD11389 |
| Group 9 (30 µg LP183-AD11390) | n = 3 | AD11390 |
| Group 10 (30 µg LP183-AD11391) | n = 3 | AD11391 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 27 below:

TABLE 27

Relative expression of SOD1 mRNA in various tissues analyzed by qPCR for each of the dosing groups of Example 9.

| | | Cortex | | | Cerebellum | | |
|---|---|---|---|---|---|---|---|
| | | Group Average (n = 3) | | | Group Average (n = 3) | | |
| Group # | Description | Rel. Exp. | Error (Low) | Error (High) | Rel. Exp. | Error (Low) | Error (High) |
| 1 | aCSF | 1.000 | 0.146 | 0.171 | 1.000 | 0.078 | 0.084 |
| 2 | 30 µg AD11196 | 0.584 | 0.097 | 0.116 | 0.395 | 0.052 | 0.060 |
| 3 | 30 µg AD11384 | 0.658 | 0.089 | 0.103 | 0.443 | 0.073 | 0.087 |
| 4 | 30 µg AD11385 | 0.875 | 0.097 | 0.110 | 0.646 | 0.109 | 0.131 |
| 5 | 30 µg AD11386 | 0.925 | 0.093 | 0.103 | 0.753 | 0.091 | 0.103 |
| 6 | 30 µg AD11387 | 0.752 | 0.079 | 0.089 | 0.825 | 0.096 | 0.109 |
| 7 | 30 µg AD11388 | 0.772 | 0.088 | 0.100 | 0.751 | 0.120 | 0.143 |
| 8 | 30 µg AD11389 | 0.621 | 0.043 | 0.047 | 0.494 | 0.032 | 0.035 |
| 9 | 30 µg AD11390 | 0.906 | 0.141 | 0.166 | 0.804 | 0.133 | 0.160 |
| 10 | 30 µg AD11391 | 0.846 | 0.123 | 0.144 | 0.842 | 0.058 | 0.063 |

| | | Thoracic Spinal Cord | | | Brainstem | | |
|---|---|---|---|---|---|---|---|
| | | Group Average (n = 3) | | | Group Average (n = 3) | | |
| Group # | Description | Rel. Exp. | Error (Low) | Error (High) | Rel. Exp. | Error (Low) | Error (High) |
| 1 | aCSF | 1.000 | 0.111 | 0.124 | 1.000 | 0.124 | 0.141 |
| 2 | 30 µg AD11196 | 0.155 | 0.080 | 0.166 | 0.349 | 0.045 | 0.051 |
| 3 | 30 µg AD11384 | 0.150 | 0.021 | 0.024 | 0.362 | 0.036 | 0.040 |
| 4 | 30 µg AD11385 | 0.333 | 0.084 | 0.112 | 0.453 | 0.047 | 0.052 |
| 5 | 30 µg AD11386 | 0.319 | 0.061 | 0.076 | 0.568 | 0.059 | 0.066 |
| 6 | 30 µg AD11387 | 0.380 | 0.030 | 0.033 | 0.620 | 0.072 | 0.082 |
| 7 | 30 µg AD11388 | 0.481 | 0.096 | 0.120 | 0.677 | 0.104 | 0.123 |
| 8 | 30 µg AD11389 | 0.337 | 0.054 | 0.065 | 0.362 | 0.031 | 0.034 |
| 9 | 30 µg AD11390 | 0.802 | 0.062 | 0.067 | 0.864 | 0.139 | 0.166 |
| 10 | 30 µg AD11391 | 0.755 | 0.038 | 0.040 | 0.934 | 0.140 | 0.164 |

As shown in Table 27, nearly every dosing group showed meaningful improvement in mRNA knockdown over the aCSF-administered group in every tissue analyzed.

Example 10. In Vivo Knockdown of SOD1 in Transgenic Tg SOD1 G93A Mice

On Study day 1, Tg SOD1 G93A mice were injected with either 10 μL artificial cerebrospinal fluid (aCSF, obtained from a commercial supplier) or 10 μL of compound formulation at a concentration of 3 mg/mL in aCSF according to Table 28 below:

TABLE 28

Dosing groups for the mice of Example 10.

| Group ID | Animals dosed | AD Duplex Number |
|---|---|---|
| Group 1 (aCSF) | n = 3 | N/A |
| Group 2 (30 μg LP183-AD11196) | n = 3 | AD11196 |
| Group 3 (30 μg LP183-AD11429) | n = 3 | AD11429 |
| Group 4 (30 μg LP183-AD11430) | n = 3 | AD11430 |
| Group 5 (30 μg LP183-AD11431) | n = 3 | AD11431 |
| Group 6 (30 μg LP183-AD11432) | n = 3 | AD11432 |
| Group 7 (30 μg LP183-AD11433) | n = 3 | AD11433 |
| Group 8 (30 μg LP183-AD11434) | n = 3 | AD11434 |
| Group 9 (30 μg LP183-AD11435) | n = 3 | AD11435 |
| Group 10 (30 μg LP183-AD11436) | n = 3 | AD11436 |
| Group 11 (30 μg LP183-AD11437) | n = 3 | AD11437 |
| Group 12 (30 μg LP183-AD11438) | n = 3 | AD11438 |
| Group 13 (30 μg LP183-AD11439) | n = 3 | AD11439 |
| Group 14 (30 μg LP183-AD11440) | n = 3 | AD11440 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 29 below:

TABLE 29

Relative expression of SOD1 mRNA in various tissues analyzed by qPCR for each of the dosing groups of Example 10.

| | | Cortex | | | Cerebellum | | |
|---|---|---|---|---|---|---|---|
| | | Group Average (n = 3) | | | Group Average (n = 3) | | |
| Group # | Description | Rel. Exp. | Error (Low) | Error (High) | Rel. Exp. | Error (Low) | Error (High) |
| 1 | aCSF | 1.000 | 0.087 | 0.096 | 1.000 | 0.132 | 0.152 |
| 2 | 30 μg AD11196 | 0.611 | 0.060 | 0.067 | 0.431 | 0.014 | 0.015 |
| 3 | 30 μg AD11429 | 1.031 | 0.093 | 0.102 | 0.797 | 0.133 | 0.159 |
| 4 | 30 μg AD11430 | 1.067 | 0.101 | 0.111 | 0.873 | 0.097 | 0.110 |
| 5 | 30 μg AD11431 | 1.079 | 0.052 | 0.054 | 0.678 | 0.065 | 0.072 |
| 6 | 30 μg AD11432 | 1.084 | 0.076 | 0.082 | 0.910 | 0.050 | 0.053 |
| 7 | 30 μg AD11433 | 0.885 | 0.058 | 0.062 | 0.648 | 0.053 | 0.057 |
| 8 | 30 μg AD11434 | 0.873 | 0.057 | 0.061 | 0.589 | 0.084 | 0.098 |
| 9 | 30 μg AD11435 | 0.968 | 0.120 | 0.137 | 0.855 | 0.143 | 0.172 |
| 10 | 30 μg AD11436 | 0.966 | 0.070 | 0.075 | 0.889 | 0.049 | 0.052 |
| 11 | 30 μg AD11437 | 0.832 | 0.145 | 0.175 | 0.755 | 0.063 | 0.069 |
| 12 | 30 μg AD11438 | 0.936 | 0.111 | 0.126 | 0.878 | 0.131 | 0.154 |
| 13 | 30 μg AD11439 | 1.087 | 0.046 | 0.048 | 0.800 | 0.102 | 0.117 |
| 14 | 30 μg AD11440 | 0.888 | 0.168 | 0.208 | 0.781 | 0.161 | 0.204 |

TABLE 29-continued

Relative expression of SOD1 mRNA in various tissues analyzed by qPCR for each of the dosing groups of Example 10.

| | | Thoracic Spinal Cord | | | Brainstem | | |
|---|---|---|---|---|---|---|---|
| | | Group Average (n = 3) | | | Group Average (n = 3) | | |
| Group # | Description | Rel. Exp. | Error (Low) | Error (High) | Rel. Exp. | Error (Low) | Error (High) |
| 1 | aCSF | 1.000 | 0.103 | 0.115 | 1.000 | 0.093 | 0.103 |
| 2 | 30 μg AD11196 | 0.362 | 0.073 | 0.092 | 0.576 | 0.050 | 0.055 |
| 3 | 30 μg AD11429 | 0.877 | 0.072 | 0.078 | 1.125 | 0.129 | 0.146 |
| 4 | 30 μg AD11430 | 0.815 | 0.078 | 0.086 | 0.983 | 0.065 | 0.069 |
| 5 | 30 μg AD11431 | 0.740 | 0.153 | 0.193 | 1.021 | 0.106 | 0.119 |
| 6 | 30 μg AD11432 | 0.830 | 0.191 | 0.248 | 0.945 | 0.201 | 0.255 |
| 7 | 30 μg AD11433 | 0.324 | 0.072 | 0.092 | 0.534 | 0.054 | 0.061 |
| 8 | 30 μg AD11434 | 0.654 | 0.057 | 0.063 | 0.745 | 0.071 | 0.079 |
| 9 | 30 μg AD11435 | 0.805 | 0.122 | 0.144 | 1.053 | 0.078 | 0.084 |
| 10 | 30 μg AD11436 | 0.725 | 0.120 | 0.144 | 0.965 | 0.089 | 0.098 |
| 11 | 30 μg AD11437 | 0.730 | 0.110 | 0.129 | 1.078 | 0.076 | 0.081 |
| 12 | 30 μg AD11438 | 0.782 | 0.090 | 0.102 | 1.247 | 0.195 | 0.232 |
| 13 | 30 μg AD11439 | 0.805 | 0.042 | 0.044 | 1.302 | 0.060 | 0.063 |
| 14 | 30 μg AD11440 | 0.847 | 0.158 | 0.195 | 0.939 | 0.168 | 0.204 |

Example 11. In Vivo Knockdown of SOD1 in Transgenic Tg SOD1 G93A Mice

On Study day 1, Tg SOD1 G93A mice were injected with either 10 μL artificial cerebrospinal fluid (aCSF, obtained from a commercial supplier) or 10 μL of compound formulation at a concentration of 1 mg/mL for groups 2-4, 3 mg/mL for groups 5-7, and 10 mg/mL for groups 8-10 in aCSF according to Table 30 below:

TABLE 30

Dosing groups for the mice of Example 11.

| Group ID | Animals dosed | AC Duplex Number |
|---|---|---|
| Group 1 (aCSF) | n = 3 | N/A |
| Group 2 (10 μg LP183-AD10083) | n = 3 | AC001807 |
| Group 3 (10 μg LP183-AD11556) | n = 3 | AC002478 |
| Group 4 (10 μg LP293-AD11556) | n = 3 | AC002479 |
| Group 5 (30 μg LP183-AD10083) | n = 3 | AC001807 |
| Group 6 (30 μg LP183-AD11556) | n = 3 | AC002478 |
| Group 7 (30 μg LP293-AD11556) | n = 3 | AC002479 |
| Group 8 (100 μg LP183-AD10083) | n = 3 | AC001807 |
| Group 9 (100 μg LP293-AD11556) | n = 3 | AC002478 |
| Group 10 (100 μg LP293-AD11556) | n = 3 | AC002479 |

Mice were injected intracerebroventricularly on day 1. On day 8, mice were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 31 below:

TABLE 31

Relative expression of SOD1 mRNA in various tissues analyzed by qPCR for each of the dosing groups of Example 11.

| Group # | Description | Cortex Group Average (n = 3) | | | Cerebellum Group Average (n = 3) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.071 | 0.076 | 1.000 | 0.130 | 0.150 |
| 2 | 10 µg AC001807 | 1.001 | 0.050 | 0.052 | 1.094 | 0.115 | 0.128 |
| 3 | 10 µg AC002478 | 0.769 | 0.114 | 0.134 | 0.620 | 0.190 | 0.274 |
| 4 | 10 µg AC002479 | 0.893 | 0.068 | 0.074 | 0.754 | 0.136 | 0.167 |
| 5 | 30 µg AC001807 | 0.702 | 0.080 | 0.090 | 0.807 | 0.144 | 0.175 |
| 6 | 30 µg AC002478 | 0.597 | 0.063 | 0.071 | 0.353 | 0.027 | 0.029 |
| 7 | 30 µg AC002479 | 0.782 | 0.092 | 0.104 | 0.548 | 0.052 | 0.058 |
| 8 | 100 µg AC001807 | 0.726 | 0.143 | 0.178 | 0.368 | 0.087 | 0.114 |
| 9 | 100 µg AC002478 | 0.448 | 0.020 | 0.021 | 0.209 | 0.033 | 0.040 |
| 10 | 100 µg AC002479 | 0.434 | 0.083 | 0.102 | 0.244 | 0.023 | 0.025 |

| Group # | Description | Thoracic Spinal Cord Group Average (n = 3) | | | Brainstem Group Average (n = 3) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.142 | 0.166 | 1.000 | 0.188 | 0.232 |
| 2 | 10 µg AC001807 | 1.070 | 0.092 | 0.101 | 1.020 | 0.187 | 0.229 |
| 3 | 10 µg AC002478 | 0.471 | 0.054 | 0.061 | 0.779 | 0.103 | 0.119 |
| 4 | 10 µg AC002479 | 0.767 | 0.055 | 0.059 | 0.971 | 0.155 | 0.184 |
| 5 | 30 µg AC001807 | 0.667 | 0.175 | 0.238 | 0.806 | 0.062 | 0.068 |
| 6 | 30 µg AC002478 | 0.324 | 0.041 | 0.047 | 0.530 | 0.088 | 0.105 |
| 7 | 30 µg AC002479 | 0.360 | 0.149 | 0.255 | 0.563 | 0.114 | 0.143 |
| 8 | 100 µg AC001807 | 0.150 | 0.008 | 0.009 | 0.195 | 0.029 | 0.034 |
| 9 | 100 µg AC002478 | 0.096 | 0.049 | 0.099 | 0.210 | 0.054 | 0.072 |
| 10 | 100 µg AC002479 | 0.293 | 0.070 | 0.092 | 0.270 | 0.016 | 0.017 |

As shown in Table 31, almost every dosing group showed improvement in mRNA knockdown over the aCSF-administered group in every tissue analyzed.

Example 12. In Vivo Knockdown of SOD1 in Transgenic Tg SOD1 G93A Rats

On Study day 1, Tg SOD1 G93A rats were injected with either 30 µL artificial cerebrospinal fluid (aCSF, obtained from a commercial supplier) or 30 µL of compound formulation at a concentration of 0.33, 1.0, 3.33, 10, and 30 mg/mL for groups 2-6, respectively, in aCSF according to Table 32 below:

TABLE 32

Dosing groups for the rats of Example 12.

| Group ID | Animals dosed |
|---|---|
| Group 1 (aCSF) | n = 4 |
| Group 2 (10 µg AD12261) | n = 4 |
| Group 3 (30 µg AD12261) | n = 4 |
| Group 4 (100 µg AD12261) | n = 4 |
| Group 5 (300 µg AD12261) | n = 4 |
| Group 6 (900 µg AD12261) | n = 4 |

Rats were injected intrathecally on day 1. On day 85, CSF was collected from each animal, then rats were euthanized and the left half of the brain and thoracic spinal cord were collected and stored in 10% NBF. Tissue samples were taken from the right half of the brain of thoracic spinal cord, cortex, cerebellum and brain stem. Samples were analyzed by qPCR for SOD1 mRNA knockdown. Average results for each group are shown in Table 33 below:

TABLE 33

Relative expression of SOD1 mRNA in various tissues analyzed by qPCR for each of the dosing groups of Example 12.

| Group # | Description | Cortex Group Average (n = 4) | | | Cerebellum Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.127 | 0.145 | 1.000 | 0.100 | 0.111 |
| 2 | 10 µg AD12261 | 1.148 | 0.085 | 0.092 | 0.963 | 0.106 | 0.119 |
| 3 | 30 µg AD12261 | 0.966 | 0.096 | 0.107 | 0.742 | 0.107 | 0.125 |
| 4 | 100 µg AD12261 | 0.843 | 0.267 | 0.391 | 0.572 | 0.213 | 0.339 |
| 5 | 300 µg AD12261 | 0.870 | 0.279 | 0.410 | 0.501 | 0.153 | 0.221 |
| 6 | 900 µg AD12261 | 0.733 | 0.171 | 0.223 | 0.316 | 0.097 | 0.139 |

| Group # | Description | Thoracic Spinal Cord Group Average (n = 4) | | | Brainstem Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.185 | 0.228 | 1.000 | 0.257 | 0.345 |
| 2 | 10 µg AD12261 | 1.140 | 0.115 | 0.129 | 1.056 | 0.146 | 0.170 |
| 3 | 30 µg AD12261 | 0.845 | 0.153 | 0.186 | 0.988 | 0.213 | 0.272 |
| 4 | 100 µg AD12261 | 0.595 | 0.250 | 0.430 | 0.843 | 0.300 | 0.465 |
| 5 | 300 µg AD12261 | 0.507 | 0.130 | 0.175 | 0.865 | 0.124 | 0.145 |
| 6 | 900 µg AD12261 | 0.217 | 0.066 | 0.094 | 0.605 | 0.108 | 0.132 |

As shown in Table 33, above, a dose-dependent decrease in SOD1 mRNA expression was observed for transgenic rats treated with AD12261 (also known as AC910358). Indeed, at the highest dose of 900 µg SOD1 RNAi agent AD 12261 was able to achieve approximately 27% o reductions in cortex (0.733); approximately 69% reductions in cerebellum (0.316); approximately 79% reductions in thoracic spinal cord (0.217); and approximately 40% reductions in brainstem (0.605).

Example 13. In Vivo Knockdown of SOD1 in Cynomolgus Monkeys

On Study day 1, cynomolgus monkeys were injected with either artificial cerebrospinal fluid (aCSF, obtained from a commercial supplier) or a compound formulation containing 45 mg of AD12261 in aCSF according to Table 34 below:

TABLE 34

Dosing groups for the non-human primates of Example 13.

| Group ID | Animals dosed |
|---|---|
| Group 1 (aCSF) | n = 4 |
| Group 2 (45 mg AD12261)-Day 29 | n = 5 |
| Group 3 (45 mg AD12261)-Day 85 | n = 5 |
| Group 4 (45 mg AD12261)-Day 168 | n = 5 |

Four (n=4) monkeys were dosed in group 1 (control) and five (n=5) monkeys were dosed in groups 2, 3 and 4 (trigger treated). Monkeys were injected intrathecally on day 1. On study day 29, animals from Groups 1 and 2 were euthanized and brain and spinal cord tissue was collected from each animal. On study day 85, animals from Group 3 were euthanized and brain and spinal cord tissue was collected from each animal. On study day 168, animals from Group 4 were euthanized and brain and spinal cord tissue was collected from each animal. Samples were analyzed by qPCR for SOD1 mRNA knockdown. Average results for each group, relative to Group 1, are shown in Table 35 below:

TABLE 35

Relative expression of SOD1 mRNA in various tissues analyzed by qPCR for each of the dosing groups of Example 13.

| Group # | Description | Frontal Cortex Group Average | | | Temporal Cortex Group Average | | |
|---|---|---|---|---|---|---|---|
| | | Rel. Exp. | Error (Low) | Error (High) | Rel. Exp. | Error (Low) | Error (High) |
| 1 | aCSF | 1.000 | 0.122 | 0.139 | 1.000 | 0.164 | 0.197 |
| 2-Day 29 | AD12261 (45 mg) | 0.267 | 0.191 | 0.666 | 0.184 | 0.129 | 0.437 |
| 3-Day 85 | AD12261 (45 mg) | 0.471 | 0.289 | 0.749 | 0.204 | 0.115 | 0.265 |
| 4-Day 168 | AD12261 (45 mg) | 0.463 | 0.191 | 0.326 | 0.273 | 0.101 | 0.160 |

| Group # | Description | Cerebellum (Cortex) Group Average | | | Lumbar Spinal Cord Group Average | | |
|---|---|---|---|---|---|---|---|
| | | Rel. Exp. | Error (Low) | Error (High) | Rel. Exp. | Error (Low) | Error (High) |
| 1 | aCSF | 1.000 | 0.207 | 0.262 | 1.000 | 0.535 | 1.152 |
| 2-Day 29 | AD12261 (45 mg) | 0.368 | 0.212 | 0.503 | 0.040 | 0.020 | 0.039 |
| 3-Day 85 | AD12261 (45 mg) | 0.726 | 0.220 | 0.316 | 0.025 | 0.012 | 0.024 |
| 4-Day 168 | AD12261 (45 mg) | 0.984 | 0.264 | 0.361 | 0.115 | 0.057 | 0.113 |

| Group # | Description | Cervical Spinal Cord Group Average | | | Motor Cortex Group Average | | |
|---|---|---|---|---|---|---|---|
| | | Rel. Exp. | Error (Low) | Error (High) | Rel. Exp. | Error (Low) | Error (High) |
| 1 | aCSF | 1.000 | 0.297 | 0.422 | 1.000 | 0.183 | 0.224 |
| 2-Day 29 | AD12261 (45 mg) | 0.119 | 0.080 | 0.238 | 0.281 | 0.178 | 0.490 |
| 3-Day 85 | AD12261 (45 mg) | 0.372 | 0.176 | 0.335 | 0.188 | 0.091 | 0.176 |
| 4-Day 168 | AD12261 (45 mg) | 0.906 | 0.206 | 0.266 | 0.676 | 0.364 | 0.790 |

| Group # | Description | Hippocampus Group Average | | | Pons Group Average | | |
|---|---|---|---|---|---|---|---|
| | | Rel. Exp. | Error (Low) | Error (High) | Rel. Exp. | Error (Low) | Error (High) |
| 1 | aCSF | 1.000 | 0.180 | 0.220 | 1.000 | 0.370 | 0.586 |
| 2-Day 29 | AD12261 (45 mg) | 0.175 | 0.131 | 0.520 | 0.306 | 0.176 | 0.412 |
| 3-Day 85 | AD12261 (45 mg) | 0.373 | 0.073 | 0.090 | 0.925 | 0.320 | 0.489 |
| 4-Day 168 | AD12261 (45 mg) | 0.481 | 0.155 | 0.229 | 0.981 | 0.296 | 0.425 |

| Group # | Description | Thoracic Spinal Cord Group Average | | |
|---|---|---|---|---|
| | | Rel. Exp. | Error (Low) | Error (High) |
| 1 | aCSF | 1.000 | 0.185 | 0.227 |
| 2-Day 29 | AD12261 (45 mg) | 0.122 | 0.074 | 0.188 |
| 3-Day 85 | AD12261 (45 mg) | 0.130 | 0.085 | 0.248 |
| 4-Day 168 | AD12261 (45 mg) | 0.628 | 0.255 | 0.430 |

As shown in Table 35, above, durable (up to 168 days after a single intrathecal injection) reduction of SOD1 mRNA expression was observed in multiple tissues for non-human primates treated with AD 12261.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1229 sequences)

SEQ ID NO: 1 - RNA, 895 nt, Homo sapiens
  source 1..895: mol_type = mRNA
gcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 2 - RNA, 19 nt, synthetic construct
  source 1..19: mol_type = other RNA
tcactttaatcctctatcc

SEQ ID NO: 3 - RNA, 19 nt, synthetic construct
  source 1..19: mol_type = other RNA
taactcatctgttatcctg

SEQ ID NO: 4 - RNA, 19 nt, synthetic construct
  source 1..19: mol_type = other RNA
tgaagattctgtgatctca

SEQ ID NO: 5 - RNA, 19 nt, synthetic construct
  source 1..19: mol_type = other RNA
cccagtgcagggcatcatc

SEQ ID NO: 6 - RNA, 19 nt, synthetic construct
  source 1..19: mol_type = other RNA
agcagaaggaaagtaatgg

SEQ ID NO: 7 - RNA, 19 nt, synthetic construct
  source 1..19: mol_type = other RNA
aagtaatggaccagtgaag

SEQ ID NO: 8 - RNA, 19 nt, synthetic construct
  source 1..19: mol_type = other RNA
ctgcatggattccatgttc

SEQ ID NO: 9 - RNA, 19 nt, synthetic construct
  source 1..19: mol_type = other RNA
tgcatggattccatgttca

SEQ ID NO: 10 - RNA, 19 nt, synthetic construct
  source 1..19: mol_type = other RNA
gcatggattccatgttcat

SEQ ID NO: 11 - RNA, 19 nt, synthetic construct
  source 1..19: mol_type = other RNA
tccatgttcatgagtttgg

SEQ ID NO: 12 - RNA, 19 nt, synthetic construct
  source 1..19: mol_type = other RNA
caggtcctcactttaatcc

SEQ ID NO: 13 - RNA, 19 nt, synthetic construct
  source 1..19: mol_type = other RNA
gatgaagagaggcatgttg

SEQ ID NO: 14 - RNA, 19 nt, synthetic construct
  source 1..19: mol_type = other RNA
attgaagattctgtgatct

SEQ ID NO: 15 - RNA, 19 nt, synthetic construct
  source 1..19: mol_type = other RNA
tgaagattctgtgatctca

SEQ ID NO: 16 - RNA, 19 nt, synthetic construct
  source 1..19: mol_type = other RNA
tggtggtccatgaaaaagc

SEQ ID NO: 17 - RNA, 19 nt, synthetic construct
  source 1..19: mol_type = other RNA
atgaaaaagcagatgactt

SEQ ID NO: 18 - RNA, 19 nt, synthetic construct
  source 1..19: mol_type = other RNA
tgaaaaagcagatgacttg

SEQ ID NO: 19 - RNA, 19 nt, synthetic construct
  source 1..19: mol_type = other RNA
gtggaaatgaagaaagtac

SEQ ID NO: 20 - RNA, 19 nt, synthetic construct
  source 1..19: mol_type = other RNA
ggcttgtggtgtaattggg

SEQ ID NO: 21 - RNA, 19 nt, synthetic construct
  source 1..19: mol_type = other RNA
aacattcccttggatgtag

SEQ ID NO: 22 - RNA, 19 nt, synthetic construct
  source 1..19: mol_type = other RNA
ttcccttggatgtagtctg

SEQ ID NO: 23 - RNA, 19 nt, synthetic construct
  source 1..19: mol_type = other RNA
cttaactcatctgttatcc

SEQ ID NO: 24 - RNA, 19 nt, synthetic construct
  source 1..19: mol_type = other RNA
ttaactcatctgttatcct

SEQ ID NO: 25 - RNA, 19 nt, synthetic construct
  source 1..19: mol_type = other RNA
taactcatctgttatcctg

SEQ ID NO: 26 - RNA, 19 nt, synthetic construct
  source 1..19: mol_type = other RNA
aactcatctgttatcctgc

SEQ ID NO: 27 - RNA, 19 nt, synthetic construct
  source 1..19: mol_type = other RNA
catctgttatcctgctagc

SEQ ID NO: 28 - RNA, 19 nt, synthetic construct
  source 1..19: mol_type = other RNA
tctgttatcctgctagctg

SEQ ID NO: 29 - RNA, 19 nt, synthetic construct
  source 1..19: mol_type = other RNA
tatcctgctagctgtagaa

SEQ ID NO: 30 - RNA, 19 nt, synthetic construct
  source 1..19: mol_type = other RNA
cctgctagctgtagaaatg

SEQ ID NO: 31 - RNA, 19 nt, synthetic construct
  source 1..19: mol_type = other RNA
tgctagctgtagaaatgta

SEQ ID NO: 32 - RNA, 19 nt, synthetic construct
  source 1..19: mol_type = other RNA
gctagctgtagaaatgtat

SEQ ID NO: 33 - RNA, 19 nt, synthetic construct
  source 1..19: mol_type = other RNA
tagctgtagaaatgtatcc

SEQ ID NO: 34 - RNA, 19 nt, synthetic construct
  source 1..19: mol_type = other RNA
gctgtagaaatgtatcctg

SEQ ID NO: 35 - RNA, 19 nt, synthetic construct
  source 1..19: mol_type = other RNA
ctgtagaaatgtatcctga

SEQ ID NO: 36 - RNA, 19 nt, synthetic construct
  source 1..19: mol_type = other RNA
aatgtatcctgataaacat

SEQ ID NO: 37 - RNA, 19 nt, synthetic construct
  source 1..19: mol_type = other RNA
ctgataaacattaaacact

SEQ ID NO: 38 - RNA, 19 nt, synthetic construct
  source 1..19: mol_type = other RNA
acattaaacactgtaatct

SEQ ID NO: 39 - RNA, 19 nt, synthetic construct
  source 1..19: mol_type = other RNA
attaaacactgtaatctta

SEQ ID NO: 40 - RNA, 19 nt, synthetic construct
  source 1..19: mol_type = other RNA
ctttaaagtacctgtagtg

SEQ ID NO: 41 - RNA, 19 nt, synthetic construct
  source 1..19: mol_type = other RNA
actgatttatgatcacttg

SEQ ID NO: 42 - RNA, 19 nt, synthetic construct
  source 1..19: mol_type = other RNA
atgatcacttggaagattt

SEQ ID NO: 43 - RNA, 19 nt, synthetic construct
  source 1..19: mol_type = other RNA
atcacttggaagatttgta

SEQ ID NO: 44 - RNA, 19 nt, synthetic construct
  source 1..19: mol_type = other RNA
tggaagatttgtatagttt

SEQ ID NO: 45 - RNA, 19 nt, synthetic construct
  source 1..19: mol_type = other RNA
gttaaaatgtctgtttcaa

SEQ ID NO: 46 - RNA, 19 nt, synthetic construct
  source 1..19: mol_type = other RNA
atgtctgtttcaatgacct

SEQ ID NO: 47 - RNA, 19 nt, synthetic construct
  source 1..19: mol_type = other RNA
gtttcaatgacctgtattt

SEQ ID NO: 48 - RNA, 19 nt, synthetic construct
  source 1..19: mol_type = other RNA
cctgtattttgccagactt

SEQ ID NO: 49 - RNA, 19 nt, synthetic construct
  source 1..19: mol_type = other RNA
aaatcacagatgggtatta

SEQ ID NO: 50 - RNA, 19 nt, synthetic construct
  source 1..19: mol_type = other RNA
acagatgggtattaaactt

SEQ ID NO: 51 - RNA, 19 nt, synthetic construct
  source 1..19: mol_type = other RNA
cagatgggtattaaacttg

SEQ ID NO: 52 - RNA, 19 nt, synthetic construct
  source 1..19: mol_type = other RNA
agatgggtattaaacttgt

SEQ ID NO: 53 - RNA, 19 nt, synthetic construct
  source 1..19: mol_type = other RNA
atgggtattaaacttgtca

SEQ ID NO: 54 - RNA, 19 nt, synthetic construct
  source 1..19: mol_type = other RNA
tgatagaggattaaagtga

SEQ ID NO: 55 - RNA, 19 nt, synthetic construct
  source 1..19: mol_type = other RNA
agatagaggattaaagtga

SEQ ID NO: 56 - RNA, 19 nt, synthetic construct
  source 1..19: mol_type = other RNA
ggatagaggattaaagtga

SEQ ID NO: 57 - RNA, 19 nt, synthetic construct
  source 1..19: mol_type = other RNA
ngatagaggattaaagtga

SEQ ID NO: 58 - RNA, 19 nt, synthetic construct
  source 1..19: mol_type = other RNA
ngatagaggattaaagtgn

SEQ ID NO: 59 - RNA, 19 nt, synthetic construct
  source 1..19: mol_type = other RNA
taggataacagatgagtta

SEQ ID NO: 60 - RNA, 19 nt, synthetic construct
  source 1..19: mol_type = other RNA
aaggataacagatgagtta

SEQ ID NO: 61 - RNA, 19 nt, synthetic construct
  source 1..19: mol_type = other RNA
caggataacagatgagtta

SEQ ID NO: 62 - RNA, 19 nt, synthetic construct
  source 1..19: mol_type = other RNA
naggataacagatgagtta

SEQ ID NO: 63 - RNA, 19 nt, synthetic construct
  source 1..19: mol_type = other RNA
naggataacagatgagttn

SEQ ID NO: 64 - RNA, 19 nt, synthetic construct
  source 1..19: mol_type = other RNA
tgagatcacagaatcttca

SEQ ID NO: 65 - RNA, 19 nt, synthetic construct
  source 1..19: mol_type = other RNA
agagatcacagaatcttca

SEQ ID NO: 66 - RNA, 19 nt, synthetic construct
  source 1..19: mol_type = other RNA
ngagatcacagaatcttca

SEQ ID NO: 67 - RNA, 19 nt, synthetic construct
  source 1..19: mol_type = other RNA
ngagatcacagaatcttcn

SEQ ID NO: 68 - RNA, 19 nt, synthetic construct
  source 1..19: mol_type = other RNA
tatgatgccctgcactggg

SEQ ID NO: 69 - RNA, 19 nt, synthetic construct
  source 1..19: mol_type = other RNA
aatgatgccctgcactggg

SEQ ID NO: 70 - RNA, 19 nt, synthetic construct
  source 1..19: mol_type = other RNA
gatgatgccctgcactggg

SEQ ID NO: 71 - RNA, 19 nt, synthetic construct
  source 1..19: mol_type = other RNA
natgatgccctgcactggg

SEQ ID NO: 72 - RNA, 19 nt, synthetic construct
  source 1..19: mol_type = other RNA
natgatgccctgcactggn

SEQ ID NO: 73 - RNA, 19 nt, synthetic construct
  source 1..19: mol_type = other RNA
tcattactttccttctgct

SEQ ID NO: 74 - RNA, 19 nt, synthetic construct
  source 1..19: mol_type = other RNA
acattactttccttctgct

SEQ ID NO: 75 - RNA, 19 nt, synthetic construct
  source 1..19: mol_type = other RNA
ccattactttccttctgct

SEQ ID NO: 76 - RNA, 19 nt, synthetic construct
  source 1..19: mol_type = other RNA
ncattactttccttctgct

SEQ ID NO: 77 - RNA, 19 nt, synthetic construct
  source 1..19: mol_type = other RNA
ncattactttccttctgcn

SEQ ID NO: 78 - RNA, 19 nt, synthetic construct
  source 1..19: mol_type = other RNA
tttcactggtccattactt

SEQ ID NO: 79 - RNA, 19 nt, synthetic construct
  source 1..19: mol_type = other RNA
attcactggtccattactt

SEQ ID NO: 80 - RNA, 19 nt, synthetic construct
  source 1..19: mol_type = other RNA
cttcactggtccattactt

SEQ ID NO: 81 - RNA, 19 nt, synthetic construct
  source 1..19: mol_type = other RNA
nttcactggtccattactt

SEQ ID NO: 82 - RNA, 19 nt, synthetic construct
  source 1..19: mol_type = other RNA
nttcactggtccattactn

SEQ ID NO: 83 - RNA, 19 nt, synthetic construct
  source 1..19: mol_type = other RNA
taacatggaatccatgcag

SEQ ID NO: 84 - RNA, 19 nt, synthetic construct
  source 1..19: mol_type = other RNA
aaacatggaatccatgcag

SEQ ID NO: 85 - RNA, 19 nt, synthetic construct
  source 1..19: mol_type = other RNA
gaacatggaatccatgcag

SEQ ID NO: 86 - RNA, 19 nt, synthetic construct
  source 1..19: mol_type = other RNA
naacatggaatccatgcag

SEQ ID NO: 87 - RNA, 19 nt, synthetic construct
  source 1..19: mol_type = other RNA
naacatggaatccatgcan

SEQ ID NO: 88 - RNA, 19 nt, synthetic construct
  source 1..19: mol_type = other RNA
tgaacatggaatccatgca

SEQ ID NO: 89 - RNA, 19 nt, synthetic construct
  source 1..19: mol_type = other RNA
agaacatggaatccatgca

SEQ ID NO: 90 - RNA, 19 nt, synthetic construct
  source 1..19: mol_type = other RNA
ngaacatggaatccatgca

SEQ ID NO: 91 - RNA, 19 nt, synthetic construct
  source 1..19: mol_type = other RNA
ngaacatggaatccatgcn

SEQ ID NO: 92 - RNA, 19 nt, synthetic construct
  source 1..19: mol_type = other RNA
atgaacatggaatccatgc

SEQ ID NO: 93 - RNA, 19 nt, synthetic construct
  source 1..19: mol_type = other RNA
ttgaacatggaatccatgc

SEQ ID NO: 94 - RNA, 19 nt, synthetic construct
  source 1..19: mol_type = other RNA
ntgaacatggaatccatgc

SEQ ID NO: 95 - RNA, 19 nt, synthetic construct
  source 1..19: mol_type = other RNA
ntgaacatggaatccatgn

SEQ ID NO: 96 - RNA, 19 nt, synthetic construct
  source 1..19: mol_type = other RNA
tcaaactcatgaacatgga

SEQ ID NO: 97 - RNA, 19 nt, synthetic construct
  source 1..19: mol_type = other RNA
acaaactcatgaacatgga

SEQ ID NO: 98 - RNA, 19 nt, synthetic construct
  source 1..19: mol_type = other RNA
ccaaactcatgaacatgga

SEQ ID NO: 99 - RNA, 19 nt, synthetic construct
  source 1..19: mol_type = other RNA
ncaaactcatgaacatgga

SEQ ID NO: 100 - RNA, 19 nt, synthetic construct
  source 1..19: mol_type = other RNA
ncaaactcatgaacatggn

SEQ ID NO: 101 - RNA, 19 nt, synthetic construct
  source 1..19: mol_type = other RNA
tgattaaagtgaggacctg

SEQ ID NO: 102 - RNA, 19 nt, synthetic construct
  source 1..19: mol_type = other RNA
agattaaagtgaggacctg

SEQ ID NO: 103 - RNA, 19 nt, synthetic construct
  source 1..19: mol_type = other RNA
ggattaaagtgaggacctg

SEQ ID NO: 104 - RNA, 19 nt, synthetic construct
  source 1..19: mol_type = other RNA
ngattaaagtgaggacctg

SEQ ID NO: 105 - RNA, 19 nt, synthetic construct
  source 1..19: mol_type = other RNA
ngattaaagtgaggacctn

SEQ ID NO: 106 - RNA, 19 nt, synthetic construct
  source 1..19: mol_type = other RNA
taacatgcctctcttcatc

SEQ ID NO: 107 - RNA, 19 nt, synthetic construct
  source 1..19: mol_type = other RNA
aaacatgcctctcttcatc

SEQ ID NO: 108 - RNA, 19 nt, synthetic construct
  source 1..19: mol_type = other RNA
caacatgcctctcttcatc

SEQ ID NO: 109 - RNA, 19 nt, synthetic construct
  source 1..19: mol_type = other RNA
naacatgcctctcttcatc

SEQ ID NO: 110 - RNA, 19 nt, synthetic construct
  source 1..19: mol_type = other RNA
naacatgcctctcttcatn

SEQ ID NO: 111 - RNA, 19 nt, synthetic construct
  source 1..19: mol_type = other RNA
agatcacagaatcttcaat

SEQ ID NO: 112 - RNA, 19 nt, synthetic construct
  source 1..19: mol_type = other RNA
tgatcacagaatcttcaat

SEQ ID NO: 113 - RNA, 19 nt, synthetic construct
  source 1..19: mol_type = other RNA
ngatcacagaatcttcaat

SEQ ID NO: 114 - RNA, 19 nt, synthetic construct
  source 1..19: mol_type = other RNA
ngatcacagaatcttcaan

SEQ ID NO: 115 - RNA, 19 nt, synthetic construct
  source 1..19: mol_type = other RNA
tgagatcacagaatcttca

SEQ ID NO: 116 - RNA, 19 nt, synthetic construct
  source 1..19: mol_type = other RNA
agagatcacagaatcttca

SEQ ID NO: 117 - RNA, 19 nt, synthetic construct
  source 1..19: mol_type = other RNA
ngagatcacagaatcttca

SEQ ID NO: 118 - RNA, 19 nt, synthetic construct
  source 1..19: mol_type = other RNA
ngagatcacagaatcttcn

SEQ ID NO: 119 - RNA, 19 nt, synthetic construct
  source 1..19: mol_type = other RNA
tctttttcatggaccacca

SEQ ID NO: 120 - RNA, 19 nt, synthetic construct
  source 1..19: mol_type = other RNA
actttttcatggaccacca

SEQ ID NO: 121 - RNA, 19 nt, synthetic construct
  source 1..19: mol_type = other RNA
gctttttcatggaccacca

SEQ ID NO: 122 - RNA, 19 nt, synthetic construct
  source 1..19: mol_type = other RNA
nctttttcatggaccacca

SEQ ID NO: 123 - RNA, 19 nt, synthetic construct
  source 1..19: mol_type = other RNA
nctttttcatggaccaccn

SEQ ID NO: 124 - RNA, 19 nt, synthetic construct
  source 1..19: mol_type = other RNA
aagtcatctgctttttcat

SEQ ID NO: 125 - RNA, 19 nt, synthetic construct
  source 1..19: mol_type = other RNA
tagtcatctgctttttcat

SEQ ID NO: 126 - RNA, 19 nt, synthetic construct
  source 1..19: mol_type = other RNA
nagtcatctgctttttcat

SEQ ID NO: 127 - RNA, 19 nt, synthetic construct
  source 1..19: mol_type = other RNA
nagtcatctgctttttcan

SEQ ID NO: 128 - RNA, 19 nt, synthetic construct
  source 1..19: mol_type = other RNA
taagtcatctgctttttca

SEQ ID NO: 129 - RNA, 19 nt, synthetic construct
  source 1..19: mol_type = other RNA
aaagtcatctgctttttca

SEQ ID NO: 130 - RNA, 19 nt, synthetic construct
  source 1..19: mol_type = other RNA
caagtcatctgctttttca

SEQ ID NO: 131 - RNA, 19 nt, synthetic construct
  source 1..19: mol_type = other RNA
naagtcatctgctttttca

SEQ ID NO: 132 - RNA, 19 nt, synthetic construct
  source 1..19: mol_type = other RNA
naagtcatctgctttttcn

SEQ ID NO: 133 - RNA, 19 nt, synthetic construct
  source 1..19: mol_type = other RNA
ttactttcttcatttccac

SEQ ID NO: 134 - RNA, 19 nt, synthetic construct
  source 1..19: mol_type = other RNA
atactttcttcatttccac

SEQ ID NO: 135 - RNA, 19 nt, synthetic construct
  source 1..19: mol_type = other RNA
gtactttcttcatttccac

SEQ ID NO: 136 - RNA, 19 nt, synthetic construct
  source 1..19: mol_type = other RNA
ntactttcttcatttccac

SEQ ID NO: 137 - RNA, 19 nt, synthetic construct
  source 1..19: mol_type = other RNA
ntactttcttcatttccan

SEQ ID NO: 138 - RNA, 19 nt, synthetic construct
  source 1..19: mol_type = other RNA
tccaattacaccacaagcc

SEQ ID NO: 139 - RNA, 19 nt, synthetic construct
  source 1..19: mol_type = other RNA
accaattacaccacaagcc

SEQ ID NO: 140 - RNA, 19 nt, synthetic construct
  source 1..19: mol_type = other RNA
cccaattacaccacaagcc

SEQ ID NO: 141 - RNA, 19 nt, synthetic construct
  source 1..19: mol_type = other RNA
nccaattacaccacaagcc

SEQ ID NO: 142 - RNA, 19 nt, synthetic construct
  source 1..19: mol_type = other RNA
nccaattacaccacaagcn

SEQ ID NO: 143 - RNA, 19 nt, synthetic construct
  source 1..19: mol_type = other RNA
ttacatccaagggaatgtt

SEQ ID NO: 144 - RNA, 19 nt, synthetic construct
  source 1..19: mol_type = other RNA
atacatccaagggaatgtt

SEQ ID NO: 145 - RNA, 19 nt, synthetic construct
  source 1..19: mol_type = other RNA
ctacatccaagggaatgtt

SEQ ID NO: 146 - RNA, 19 nt, synthetic construct
  source 1..19: mol_type = other RNA
ntacatccaagggaatgtt

SEQ ID NO: 147 - RNA, 19 nt, synthetic construct
  source 1..19: mol_type = other RNA
ntacatccaagggaatgtn

SEQ ID NO: 148 - RNA, 19 nt, synthetic construct
  source 1..19: mol_type = other RNA
tagactacatccaagggaa

SEQ ID NO: 149 - RNA, 19 nt, synthetic construct
  source 1..19: mol_type = other RNA
aagactacatccaagggaa

SEQ ID NO: 150 - RNA, 19 nt, synthetic construct
  source 1..19: mol_type = other RNA
cagactacatccaagggaa

SEQ ID NO: 151 - RNA, 19 nt, synthetic construct
  source 1..19: mol_type = other RNA
nagactacatccaagggaa

SEQ ID NO: 152 - RNA, 19 nt, synthetic construct
  source 1..19: mol_type = other RNA
nagactacatccaagggan

SEQ ID NO: 153 - RNA, 19 nt, synthetic construct
  source 1..19: mol_type = other RNA
tgataacagatgagttaag

SEQ ID NO: 154 - RNA, 19 nt, synthetic construct
  source 1..19: mol_type = other RNA
agataacagatgagttaag

SEQ ID NO: 155 - RNA, 19 nt, synthetic construct
  source 1..19: mol_type = other RNA
ggataacagatgagttaag

SEQ ID NO: 156 - RNA, 19 nt, synthetic construct
  source 1..19: mol_type = other RNA
ngataacagatgagttaag

SEQ ID NO: 157 - RNA, 19 nt, synthetic construct
  source 1..19: mol_type = other RNA
ngataacagatgagttaan

SEQ ID NO: 158 - RNA, 19 nt, synthetic construct
  source 1..19: mol_type = other RNA
aggataacagatgagttaa

SEQ ID NO: 159 - RNA, 19 nt, synthetic construct
  source 1..19: mol_type = other RNA
tggataacagatgagttaa

SEQ ID NO: 160 - RNA, 19 nt, synthetic construct
  source 1..19: mol_type = other RNA
nggataacagatgagttaa

SEQ ID NO: 161 - RNA, 19 nt, synthetic construct
  source 1..19: mol_type = other RNA
nggataacagatgagttan

SEQ ID NO: 162 - RNA, 19 nt, synthetic construct
  source 1..19: mol_type = other RNA
taggataacagatgagtta

SEQ ID NO: 163 - RNA, 19 nt, synthetic construct
  source 1..19: mol_type = other RNA
aaggataacagatgagtta

SEQ ID NO: 164 - RNA, 19 nt, synthetic construct
  source 1..19: mol_type = other RNA
caggataacagatgagtta

SEQ ID NO: 165 - RNA, 19 nt, synthetic construct
  source 1..19: mol_type = other RNA
naggataacagatgagtta

SEQ ID NO: 166 - RNA, 19 nt, synthetic construct
  source 1..19: mol_type = other RNA
naggataacagatgagttn

SEQ ID NO: 167 - RNA, 19 nt, synthetic construct
  source 1..19: mol_type = other RNA
tcaggataacagatgagtt

SEQ ID NO: 168 - RNA, 19 nt, synthetic construct
  source 1..19: mol_type = other RNA
acaggataacagatgagtt

SEQ ID NO: 169 - RNA, 19 nt, synthetic construct
  source 1..19: mol_type = other RNA
gcaggataacagatgagtt

SEQ ID NO: 170 - RNA, 19 nt, synthetic construct
  source 1..19: mol_type = other RNA
ncaggataacagatgagtt

SEQ ID NO: 171 - RNA, 19 nt, synthetic construct
  source 1..19: mol_type = other RNA
ncaggataacagatgagtn

SEQ ID NO: 172 - RNA, 19 nt, synthetic construct
  source 1..19: mol_type = other RNA
tctagcaggataacagatg

SEQ ID NO: 173 - RNA, 19 nt, synthetic construct
  source 1..19: mol_type = other RNA
actagcaggataacagatg

SEQ ID NO: 174 - RNA, 19 nt, synthetic construct
  source 1..19: mol_type = other RNA
gctagcaggataacagatg

SEQ ID NO: 175 - RNA, 19 nt, synthetic construct
  source 1..19: mol_type = other RNA
nctagcaggataacagatg

SEQ ID NO: 176 - RNA, 19 nt, synthetic construct
  source 1..19: mol_type = other RNA
nctagcaggataacagatn

SEQ ID NO: 177 - RNA, 19 nt, synthetic construct
  source 1..19: mol_type = other RNA
tagctagcaggataacaga

SEQ ID NO: 178 - RNA, 19 nt, synthetic construct
  source 1..19: mol_type = other RNA
aagctagcaggataacaga

SEQ ID NO: 179 - RNA, 19 nt, synthetic construct
  source 1..19: mol_type = other RNA
cagctagcaggataacaga

SEQ ID NO: 180 - RNA, 19 nt, synthetic construct
  source 1..19: mol_type = other RNA
nagctagcaggataacaga

SEQ ID NO: 181 - RNA, 19 nt, synthetic construct
  source 1..19: mol_type = other RNA
nagctagcaggataacagn

SEQ ID NO: 182 - RNA, 19 nt, synthetic construct
  source 1..19: mol_type = other RNA
ttctacagctagcaggata

SEQ ID NO: 183 - RNA, 19 nt, synthetic construct
  source 1..19: mol_type = other RNA
atctacagctagcaggata

SEQ ID NO: 184 - RNA, 19 nt, synthetic construct
  source 1..19: mol_type = other RNA
ntctacagctagcaggata

SEQ ID NO: 185 - RNA, 19 nt, synthetic construct
  source 1..19: mol_type = other RNA
ntctacagctagcaggatn

SEQ ID NO: 186 - RNA, 19 nt, synthetic construct
  source 1..19: mol_type = other RNA
tatttctacagctagcagg

SEQ ID NO: 187 - RNA, 19 nt, synthetic construct
  source 1..19: mol_type = other RNA
aatttctacagctagcagg

SEQ ID NO: 188 - RNA, 19 nt, synthetic construct
  source 1..19: mol_type = other RNA
catttctacagctagcagg

SEQ ID NO: 189 - RNA, 19 nt, synthetic construct
  source 1..19: mol_type = other RNA
natttctacagctagcagg

SEQ ID NO: 190 - RNA, 19 nt, synthetic construct
  source 1..19: mol_type = other RNA
natttctacagctagcagn

SEQ ID NO: 191 - RNA, 19 nt, synthetic construct
  source 1..19: mol_type = other RNA
tacatttctacagctagca

SEQ ID NO: 192 - RNA, 19 nt, synthetic construct
  source 1..19: mol_type = other RNA
aacatttctacagctagca

SEQ ID NO: 193 - RNA, 19 nt, synthetic construct
  source 1..19: mol_type = other RNA
nacatttctacagctagca

SEQ ID NO: 194 - RNA, 19 nt, synthetic construct
  source 1..19: mol_type = other RNA
nacatttctacagctagcn

SEQ ID NO: 195 - RNA, 19 nt, synthetic construct
  source 1..19: mol_type = other RNA
atacatttctacagctagc

SEQ ID NO: 196 - RNA, 19 nt, synthetic construct
  source 1..19: mol_type = other RNA
ttacatttctacagctagc

SEQ ID NO: 197 - RNA, 19 nt, synthetic construct
  source 1..19: mol_type = other RNA
ntacatttctacagctagc

SEQ ID NO: 198 - RNA, 19 nt, synthetic construct
  source 1..19: mol_type = other RNA
ntacatttctacagctagn

SEQ ID NO: 199 - RNA, 19 nt, synthetic construct
  source 1..19: mol_type = other RNA
tgatacatttctacagcta

SEQ ID NO: 200 - RNA, 19 nt, synthetic construct
  source 1..19: mol_type = other RNA
agatacatttctacagcta

SEQ ID NO: 201 - RNA, 19 nt, synthetic construct
  source 1..19: mol_type = other RNA
ggatacatttctacagcta

SEQ ID NO: 202 - RNA, 19 nt, synthetic construct
  source 1..19: mol_type = other RNA
ngatacatttctacagcta

SEQ ID NO: 203 - RNA, 19 nt, synthetic construct
  source 1..19: mol_type = other RNA
ngatacatttctacagctn

SEQ ID NO: 204 - RNA, 19 nt, synthetic construct
  source 1..19: mol_type = other RNA
taggatacatttctacagc

SEQ ID NO: 205 - RNA, 19 nt, synthetic construct
  source 1..19: mol_type = other RNA
aaggatacatttctacagc

SEQ ID NO: 206 - RNA, 19 nt, synthetic construct
  source 1..19: mol_type = other RNA
caggatacatttctacagc

SEQ ID NO: 207 - RNA, 19 nt, synthetic construct
  source 1..19: mol_type = other RNA
naggatacatttctacagc

SEQ ID NO: 208 - RNA, 19 nt, synthetic construct
  source 1..19: mol_type = other RNA
naggatacatttctacagn

SEQ ID NO: 209 - RNA, 19 nt, synthetic construct
  source 1..19: mol_type = other RNA
tcaggatacatttctacag

SEQ ID NO: 210 - RNA, 19 nt, synthetic construct
  source 1..19: mol_type = other RNA
acaggatacatttctacag

SEQ ID NO: 211 - RNA, 19 nt, synthetic construct
  source 1..19: mol_type = other RNA
ncaggatacatttctacag

SEQ ID NO: 212 - RNA, 19 nt, synthetic construct
  source 1..19: mol_type = other RNA
ncaggatacatttctacan

SEQ ID NO: 213 - RNA, 19 nt, synthetic construct
  source 1..19: mol_type = other RNA
atgtttatcaggatacatt

SEQ ID NO: 214 - RNA, 19 nt, synthetic construct
  source 1..19: mol_type = other RNA
ttgtttatcaggatacatt

SEQ ID NO: 215 - RNA, 19 nt, synthetic construct
  source 1..19: mol_type = other RNA
ntgtttatcaggatacatt

SEQ ID NO: 216 - RNA, 19 nt, synthetic construct
  source 1..19: mol_type = other RNA
ntgtttatcaggatacatn

SEQ ID NO: 217 - RNA, 19 nt, synthetic construct
  source 1..19: mol_type = other RNA
agtgtttaatgtttatcag

SEQ ID NO: 218 - RNA, 19 nt, synthetic construct
  source 1..19: mol_type = other RNA
tgtgtttaatgtttatcag

SEQ ID NO: 219 - RNA, 19 nt, synthetic construct
  source 1..19: mol_type = other RNA
ngtgtttaatgtttatcag

SEQ ID NO: 220 - RNA, 19 nt, synthetic construct
  source 1..19: mol_type = other RNA
ngtgtttaatgtttatcan

SEQ ID NO: 221 - RNA, 19 nt, synthetic construct
  source 1..19: mol_type = other RNA
agattacagtgtttaatgt

SEQ ID NO: 222 - RNA, 19 nt, synthetic construct
  source 1..19: mol_type = other RNA
tgattacagtgtttaatgt

SEQ ID NO: 223 - RNA, 19 nt, synthetic construct
  source 1..19: mol_type = other RNA
ngattacagtgtttaatgt

SEQ ID NO: 224 - RNA, 19 nt, synthetic construct
  source 1..19: mol_type = other RNA
ngattacagtgtttaatgn

SEQ ID NO: 225 - RNA, 19 nt, synthetic construct
  source 1..19: mol_type = other RNA
taagattacagtgtttaat

SEQ ID NO: 226 - RNA, 19 nt, synthetic construct
  source 1..19: mol_type = other RNA
aaagattacagtgtttaat

SEQ ID NO: 227 - RNA, 19 nt, synthetic construct
  source 1..19: mol_type = other RNA
naagattacagtgtttaat

SEQ ID NO: 228 - RNA, 19 nt, synthetic construct
  source 1..19: mol_type = other RNA
naagattacagtgtttaan

SEQ ID NO: 229 - RNA, 19 nt, synthetic construct
  source 1..19: mol_type = other RNA
tactacaggtactttaaag

SEQ ID NO: 230 - RNA, 19 nt, synthetic construct
  source 1..19: mol_type = other RNA
aactacaggtactttaaag

SEQ ID NO: 231 - RNA, 19 nt, synthetic construct
  source 1..19: mol_type = other RNA
cactacaggtactttaaag

SEQ ID NO: 232 - RNA, 19 nt, synthetic construct
  source 1..19: mol_type = other RNA
nactacaggtactttaaag

SEQ ID NO: 233 - RNA, 19 nt, synthetic construct
  source 1..19: mol_type = other RNA
nactacaggtactttaaan

SEQ ID NO: 234 - RNA, 19 nt, synthetic construct
  source 1..19: mol_type = other RNA
taagtgatcataaatcagt

SEQ ID NO: 235 - RNA, 19 nt, synthetic construct
  source 1..19: mol_type = other RNA
aaagtgatcataaatcagt

SEQ ID NO: 236 - RNA, 19 nt, synthetic construct
  source 1..19: mol_type = other RNA
caagtgatcataaatcagt

SEQ ID NO: 237 - RNA, 19 nt, synthetic construct
  source 1..19: mol_type = other RNA
naagtgatcataaatcagt

SEQ ID NO: 238 - RNA, 19 nt, synthetic construct
  source 1..19: mol_type = other RNA
naagtgatcataaatcagn

SEQ ID NO: 239 - RNA, 19 nt, synthetic construct
  source 1..19: mol_type = other RNA
aaatcttccaagtgatcat

SEQ ID NO: 240 - RNA, 19 nt, synthetic construct
  source 1..19: mol_type = other RNA
taatcttccaagtgatcat

SEQ ID NO: 241 - RNA, 19 nt, synthetic construct
  source 1..19: mol_type = other RNA
naatcttccaagtgatcat

SEQ ID NO: 242 - RNA, 19 nt, synthetic construct
  source 1..19: mol_type = other RNA
naatcttccaagtgatcan

SEQ ID NO: 243 - RNA, 19 nt, synthetic construct
  source 1..19: mol_type = other RNA
tacaaatcttccaagtgat

SEQ ID NO: 244 - RNA, 19 nt, synthetic construct
  source 1..19: mol_type = other RNA
aacaaatcttccaagtgat

SEQ ID NO: 245 - RNA, 19 nt, synthetic construct
  source 1..19: mol_type = other RNA
nacaaatcttccaagtgat

SEQ ID NO: 246 - RNA, 19 nt, synthetic construct
  source 1..19: mol_type = other RNA
nacaaatcttccaagtgan

SEQ ID NO: 247 - RNA, 19 nt, synthetic construct
  source 1..19: mol_type = other RNA
aaactatacaaatcttcca

SEQ ID NO: 248 - RNA, 19 nt, synthetic construct
  source 1..19: mol_type = other RNA
taactatacaaatcttcca

SEQ ID NO: 249 - RNA, 19 nt, synthetic construct
  source 1..19: mol_type = other RNA
naactatacaaatcttcca

SEQ ID NO: 250 - RNA, 19 nt, synthetic construct
  source 1..19: mol_type = other RNA
naactatacaaatcttccn

SEQ ID NO: 251 - RNA, 19 nt, synthetic construct
  source 1..19: mol_type = other RNA
ttgaaacagacattttaac

SEQ ID NO: 252 - RNA, 19 nt, synthetic construct
  source 1..19: mol_type = other RNA
atgaaacagacattttaac

SEQ ID NO: 253 - RNA, 19 nt, synthetic construct
  source 1..19: mol_type = other RNA
ntgaaacagacattttaac

SEQ ID NO: 254 - RNA, 19 nt, synthetic construct
  source 1..19: mol_type = other RNA
ntgaaacagacattttaan

SEQ ID NO: 255 - RNA, 19 nt, synthetic construct
  source 1..19: mol_type = other RNA
aggtcattgaaacagacat

SEQ ID NO: 256 - RNA, 19 nt, synthetic construct
  source 1..19: mol_type = other RNA
tggtcattgaaacagacat

SEQ ID NO: 257 - RNA, 19 nt, synthetic construct
  source 1..19: mol_type = other RNA
nggtcattgaaacagacat

SEQ ID NO: 258 - RNA, 19 nt, synthetic construct
  source 1..19: mol_type = other RNA
nggtcattgaaacagacan

SEQ ID NO: 259 - RNA, 19 nt, synthetic construct
  source 1..19: mol_type = other RNA
aaatacaggtcattgaaac

SEQ ID NO: 260 - RNA, 19 nt, synthetic construct
  source 1..19: mol_type = other RNA
taatacaggtcattgaaac

SEQ ID NO: 261 - RNA, 19 nt, synthetic construct
  source 1..19: mol_type = other RNA
naatacaggtcattgaaac

SEQ ID NO: 262 - RNA, 19 nt, synthetic construct
  source 1..19: mol_type = other RNA
naatacaggtcattgaaan

SEQ ID NO: 263 - RNA, 19 nt, synthetic construct
  source 1..19: mol_type = other RNA
aagtctggcaaaatacagg

SEQ ID NO: 264 - RNA, 19 nt, synthetic construct
  source 1..19: mol_type = other RNA
tagtctggcaaaatacagg

SEQ ID NO: 265 - RNA, 19 nt, synthetic construct
  source 1..19: mol_type = other RNA
nagtctggcaaaatacagg

SEQ ID NO: 266 - RNA, 19 nt, synthetic construct
  source 1..19: mol_type = other RNA
nagtctggcaaaatacagn

SEQ ID NO: 267 - RNA, 19 nt, synthetic construct
  source 1..19: mol_type = other RNA
taatacccatctgtgattt

SEQ ID NO: 268 - RNA, 19 nt, synthetic construct
  source 1..19: mol_type = other RNA
aaatacccatctgtgattt

SEQ ID NO: 269 - RNA, 19 nt, synthetic construct
  source 1..19: mol_type = other RNA
naatacccatctgtgattt

SEQ ID NO: 270 - RNA, 19 nt, synthetic construct
  source 1..19: mol_type = other RNA
naatacccatctgtgattn

SEQ ID NO: 271 - RNA, 19 nt, synthetic construct
  source 1..19: mol_type = other RNA
aagtttaatacccatctgt

SEQ ID NO: 272 - RNA, 19 nt, synthetic construct
  source 1..19: mol_type = other RNA
tagtttaatacccatctgt

SEQ ID NO: 273 - RNA, 19 nt, synthetic construct
  source 1..19: mol_type = other RNA
nagtttaatacccatctgt

SEQ ID NO: 274 - RNA, 19 nt, synthetic construct
  source 1..19: mol_type = other RNA
nagtttaatacccatctgn

SEQ ID NO: 275 - RNA, 19 nt, synthetic construct
  source 1..19: mol_type = other RNA
taagtttaatacccatctg

SEQ ID NO: 276 - RNA, 19 nt, synthetic construct
  source 1..19: mol_type = other RNA
aaagtttaatacccatctg

SEQ ID NO: 277 - RNA, 19 nt, synthetic construct
  source 1..19: mol_type = other RNA
caagtttaatacccatctg

SEQ ID NO: 278 - RNA, 19 nt, synthetic construct
  source 1..19: mol_type = other RNA
naagtttaatacccatctg

SEQ ID NO: 279 - RNA, 19 nt, synthetic construct
  source 1..19: mol_type = other RNA
naagtttaatacccatctn

SEQ ID NO: 280 - RNA, 19 nt, synthetic construct
  source 1..19: mol_type = other RNA
acaagtttaatacccatct

SEQ ID NO: 281 - RNA, 19 nt, synthetic construct
  source 1..19: mol_type = other RNA
tcaagtttaatacccatct

SEQ ID NO: 282 - RNA, 19 nt, synthetic construct
  source 1..19: mol_type = other RNA
ncaagtttaatacccatct

SEQ ID NO: 283 - RNA, 19 nt, synthetic construct
  source 1..19: mol_type = other RNA
ncaagtttaatacccatcn

SEQ ID NO: 284 - RNA, 19 nt, synthetic construct
  source 1..19: mol_type = other RNA
tgacaagtttaatacccat

SEQ ID NO: 285 - RNA, 19 nt, synthetic construct
  source 1..19: mol_type = other RNA
agacaagtttaatacccat

SEQ ID NO: 286 - RNA, 19 nt, synthetic construct
  source 1..19: mol_type = other RNA
ngacaagtttaatacccat

SEQ ID NO: 287 - RNA, 19 nt, synthetic construct
  source 1..19: mol_type = other RNA
ngacaagtttaatacccan

SEQ ID NO: 288 - RNA, 19 nt, synthetic construct
  source 1..19: mol_type = other RNA
tcactttaatcctctatca

SEQ ID NO: 289 - RNA, 19 nt, synthetic construct
  source 1..19: mol_type = other RNA
tcactttaatcctctatct

SEQ ID NO: 290 - RNA, 19 nt, synthetic construct
  source 1..19: mol_type = other RNA
tcactttaatcctctatcc

SEQ ID NO: 291 - RNA, 19 nt, synthetic construct
  source 1..19: mol_type = other RNA
tcactttaatcctctatcn

SEQ ID NO: 292 - RNA, 19 nt, synthetic construct
  source 1..19: mol_type = other RNA
ncactttaatcctctatcn

SEQ ID NO: 293 - RNA, 19 nt, synthetic construct
  source 1..19: mol_type = other RNA
taactcatctgttatccta

SEQ ID NO: 294 - RNA, 19 nt, synthetic construct
  source 1..19: mol_type = other RNA
taactcatctgttatcctt

SEQ ID NO: 295 - RNA, 19 nt, synthetic construct
  source 1..19: mol_type = other RNA
taactcatctgttatcctg

SEQ ID NO: 296 - RNA, 19 nt, synthetic construct
  source 1..19: mol_type = other RNA
taactcatctgttatcctn

SEQ ID NO: 297 - RNA, 19 nt, synthetic construct
  source 1..19: mol_type = other RNA
naactcatctgttatcctn

SEQ ID NO: 298 - RNA, 19 nt, synthetic construct
  source 1..19: mol_type = other RNA
tgaagattctgtgatctca

SEQ ID NO: 299 - RNA, 19 nt, synthetic construct
  source 1..19: mol_type = other RNA
tgaagattctgtgatctct

SEQ ID NO: 300 - RNA, 19 nt, synthetic construct
  source 1..19: mol_type = other RNA
tgaagattctgtgatctcn

SEQ ID NO: 301 - RNA, 19 nt, synthetic construct
  source 1..19: mol_type = other RNA
ngaagattctgtgatctcn

SEQ ID NO: 302 - RNA, 19 nt, synthetic construct
  source 1..19: mol_type = other RNA
cccagtgcagggcatcata

SEQ ID NO: 303 - RNA, 19 nt, synthetic construct
  source 1..19: mol_type = other RNA
cccagtgcagggcatcatt

SEQ ID NO: 304 - RNA, 19 nt, synthetic construct
  source 1..19: mol_type = other RNA
cccagtgcagggcatcatc

SEQ ID NO: 305 - RNA, 19 nt, synthetic construct
  source 1..19: mol_type = other RNA
cccagtgcagggcatcatn

SEQ ID NO: 306 - RNA, 19 nt, synthetic construct
  source 1..19: mol_type = other RNA
nccagtgcagggcatcatn

SEQ ID NO: 307 - RNA, 19 nt, synthetic construct
  source 1..19: mol_type = other RNA
agcagaaggaaagtaatga

SEQ ID NO: 308 - RNA, 19 nt, synthetic construct
  source 1..19: mol_type = other RNA
agcagaaggaaagtaatgt

SEQ ID NO: 309 - RNA, 19 nt, synthetic construct
  source 1..19: mol_type = other RNA
agcagaaggaaagtaatgg

SEQ ID NO: 310 - RNA, 19 nt, synthetic construct
  source 1..19: mol_type = other RNA
agcagaaggaaagtaatgn

SEQ ID NO: 311 - RNA, 19 nt, synthetic construct
  source 1..19: mol_type = other RNA
ngcagaaggaaagtaatgn

SEQ ID NO: 312 - RNA, 19 nt, synthetic construct
  source 1..19: mol_type = other RNA
aagtaatggaccagtgaaa

SEQ ID NO: 313 - RNA, 19 nt, synthetic construct
  source 1..19: mol_type = other RNA
aagtaatggaccagtgaat

SEQ ID NO: 314 - RNA, 19 nt, synthetic construct
  source 1..19: mol_type = other RNA
aagtaatggaccagtgaag

SEQ ID NO: 315 - RNA, 19 nt, synthetic construct
  source 1..19: mol_type = other RNA
aagtaatggaccagtgaan

SEQ ID NO: 316 - RNA, 19 nt, synthetic construct
  source 1..19: mol_type = other RNA
nagtaatggaccagtgaan

SEQ ID NO: 317 - RNA, 19 nt, synthetic construct
  source 1..19: mol_type = other RNA
ctgcatggattccatgtta

SEQ ID NO: 318 - RNA, 19 nt, synthetic construct
  source 1..19: mol_type = other RNA
ctgcatggattccatgttt

SEQ ID NO: 319 - RNA, 19 nt, synthetic construct
  source 1..19: mol_type = other RNA
ctgcatggattccatgttc

SEQ ID NO: 320 - RNA, 19 nt, synthetic construct
  source 1..19: mol_type = other RNA
ctgcatggattccatgttn

SEQ ID NO: 321 - RNA, 19 nt, synthetic construct
  source 1..19: mol_type = other RNA
ntgcatggattccatgttn

SEQ ID NO: 322 - RNA, 19 nt, synthetic construct
  source 1..19: mol_type = other RNA
tgcatggattccatgttca

SEQ ID NO: 323 - RNA, 19 nt, synthetic construct
  source 1..19: mol_type = other RNA
tgcatggattccatgttct

SEQ ID NO: 324 - RNA, 19 nt, synthetic construct
  source 1..19: mol_type = other RNA
tgcatggattccatgttcn

SEQ ID NO: 325 - RNA, 19 nt, synthetic construct
  source 1..19: mol_type = other RNA
ngcatggattccatgttcn

SEQ ID NO: 326 - RNA, 19 nt, synthetic construct
  source 1..19: mol_type = other RNA
gcatggattccatgttcat

SEQ ID NO: 327 - RNA, 19 nt, synthetic construct
  source 1..19: mol_type = other RNA
gcatggattccatgttcaa

SEQ ID NO: 328 - RNA, 19 nt, synthetic construct
  source 1..19: mol_type = other RNA
gcatggattccatgttcan

SEQ ID NO: 329 - RNA, 19 nt, synthetic construct
  source 1..19: mol_type = other RNA
ncatggattccatgttcan

SEQ ID NO: 330 - RNA, 19 nt, synthetic construct
  source 1..19: mol_type = other RNA
tccatgttcatgagtttga

SEQ ID NO: 331 - RNA, 19 nt, synthetic construct
  source 1..19: mol_type = other RNA
tccatgttcatgagtttgt

SEQ ID NO: 332 - RNA, 19 nt, synthetic construct
  source 1..19: mol_type = other RNA
tccatgttcatgagtttgg

SEQ ID NO: 333 - RNA, 19 nt, synthetic construct
  source 1..19: mol_type = other RNA
tccatgttcatgagtttgn

SEQ ID NO: 334 - RNA, 19 nt, synthetic construct
  source 1..19: mol_type = other RNA
nccatgttcatgagtttgn

SEQ ID NO: 335 - RNA, 19 nt, synthetic construct
  source 1..19: mol_type = other RNA
caggtcctcactttaatca

SEQ ID NO: 336 - RNA, 19 nt, synthetic construct
  source 1..19: mol_type = other RNA
caggtcctcactttaatct

SEQ ID NO: 337 - RNA, 19 nt, synthetic construct
  source 1..19: mol_type = other RNA
caggtcctcactttaatcc

SEQ ID NO: 338 - RNA, 19 nt, synthetic construct
  source 1..19: mol_type = other RNA
caggtcctcactttaatcn

SEQ ID NO: 339 - RNA, 19 nt, synthetic construct
  source 1..19: mol_type = other RNA
naggtcctcactttaatcn

SEQ ID NO: 340 - RNA, 19 nt, synthetic construct
  source 1..19: mol_type = other RNA
gatgaagagaggcatgtta

SEQ ID NO: 341 - RNA, 19 nt, synthetic construct
  source 1..19: mol_type = other RNA
gatgaagagaggcatgttt

SEQ ID NO: 342 - RNA, 19 nt, synthetic construct
  source 1..19: mol_type = other RNA
gatgaagagaggcatgttg

SEQ ID NO: 343 - RNA, 19 nt, synthetic construct
  source 1..19: mol_type = other RNA
gatgaagagaggcatgttn

SEQ ID NO: 344 - RNA, 19 nt, synthetic construct
  source 1..19: mol_type = other RNA
natgaagagaggcatgttn

SEQ ID NO: 345 - RNA, 19 nt, synthetic construct
  source 1..19: mol_type = other RNA
attgaagattctgtgatct

SEQ ID NO: 346 - RNA, 19 nt, synthetic construct
  source 1..19: mol_type = other RNA
attgaagattctgtgatca

SEQ ID NO: 347 - RNA, 19 nt, synthetic construct
  source 1..19: mol_type = other RNA
attgaagattctgtgatcn

SEQ ID NO: 348 - RNA, 19 nt, synthetic construct
  source 1..19: mol_type = other RNA
nttgaagattctgtgatcn

SEQ ID NO: 349 - RNA, 19 nt, synthetic construct
  source 1..19: mol_type = other RNA
tgaagattctgtgatctca

SEQ ID NO: 350 - RNA, 19 nt, synthetic construct
  source 1..19: mol_type = other RNA
tgaagattctgtgatctct

SEQ ID NO: 351 - RNA, 19 nt, synthetic construct
  source 1..19: mol_type = other RNA
tgaagattctgtgatctcn

SEQ ID NO: 352 - RNA, 19 nt, synthetic construct
  source 1..19: mol_type = other RNA
ngaagattctgtgatctcn

SEQ ID NO: 353 - RNA, 19 nt, synthetic construct
  source 1..19: mol_type = other RNA
tggtggtccatgaaaaaga

SEQ ID NO: 354 - RNA, 19 nt, synthetic construct
  source 1..19: mol_type = other RNA
tggtggtccatgaaaaagt

SEQ ID NO: 355 - RNA, 19 nt, synthetic construct
  source 1..19: mol_type = other RNA
tggtggtccatgaaaaagc

SEQ ID NO: 356 - RNA, 19 nt, synthetic construct
  source 1..19: mol_type = other RNA
tggtggtccatgaaaaagn

SEQ ID NO: 357 - RNA, 19 nt, synthetic construct
  source 1..19: mol_type = other RNA
nggtggtccatgaaaaagn

SEQ ID NO: 358 - RNA, 19 nt, synthetic construct
  source 1..19: mol_type = other RNA
atgaaaaagcagatgactt

SEQ ID NO: 359 - RNA, 19 nt, synthetic construct
  source 1..19: mol_type = other RNA
atgaaaaagcagatgacta

SEQ ID NO: 360 - RNA, 19 nt, synthetic construct
  source 1..19: mol_type = other RNA
atgaaaaagcagatgactn

SEQ ID NO: 361 - RNA, 19 nt, synthetic construct
  source 1..19: mol_type = other RNA
ntgaaaaagcagatgactn

SEQ ID NO: 362 - RNA, 19 nt, synthetic construct
  source 1..19: mol_type = other RNA
tgaaaaagcagatgactta

SEQ ID NO: 363 - RNA, 19 nt, synthetic construct
  source 1..19: mol_type = other RNA
tgaaaaagcagatgacttt

SEQ ID NO: 364 - RNA, 19 nt, synthetic construct
  source 1..19: mol_type = other RNA
tgaaaaagcagatgacttg

SEQ ID NO: 365 - RNA, 19 nt, synthetic construct
  source 1..19: mol_type = other RNA
tgaaaaagcagatgacttn

SEQ ID NO: 366 - RNA, 19 nt, synthetic construct
  source 1..19: mol_type = other RNA
ngaaaaagcagatgacttn

SEQ ID NO: 367 - RNA, 19 nt, synthetic construct
  source 1..19: mol_type = other RNA
gtggaaatgaagaaagtaa

SEQ ID NO: 368 - RNA, 19 nt, synthetic construct
  source 1..19: mol_type = other RNA
gtggaaatgaagaaagtat

SEQ ID NO: 369 - RNA, 19 nt, synthetic construct
  source 1..19: mol_type = other RNA
gtggaaatgaagaaagtac

SEQ ID NO: 370 - RNA, 19 nt, synthetic construct
  source 1..19: mol_type = other RNA
gtggaaatgaagaaagtan

SEQ ID NO: 371 - RNA, 19 nt, synthetic construct
  source 1..19: mol_type = other RNA
ntggaaatgaagaaagtan

SEQ ID NO: 372 - RNA, 19 nt, synthetic construct
  source 1..19: mol_type = other RNA
ggcttgtggtgtaattgga

SEQ ID NO: 373 - RNA, 19 nt, synthetic construct
  source 1..19: mol_type = other RNA
ggcttgtggtgtaattggt

SEQ ID NO: 374 - RNA, 19 nt, synthetic construct
  source 1..19: mol_type = other RNA
ggcttgtggtgtaattggg

SEQ ID NO: 375 - RNA, 19 nt, synthetic construct
  source 1..19: mol_type = other RNA
ggcttgtggtgtaattggn

SEQ ID NO: 376 - RNA, 19 nt, synthetic construct
  source 1..19: mol_type = other RNA
ngcttgtggtgtaattggn

SEQ ID NO: 377 - RNA, 19 nt, synthetic construct
  source 1..19: mol_type = other RNA
aacattcccttggatgtaa

SEQ ID NO: 378 - RNA, 19 nt, synthetic construct
  source 1..19: mol_type = other RNA
aacattcccttggatgtat

SEQ ID NO: 379 - RNA, 19 nt, synthetic construct
  source 1..19: mol_type = other RNA
aacattcccttggatgtag

SEQ ID NO: 380 - RNA, 19 nt, synthetic construct
  source 1..19: mol_type = other RNA
aacattcccttggatgtan

SEQ ID NO: 381 - RNA, 19 nt, synthetic construct
  source 1..19: mol_type = other RNA
nacattcccttggatgtan

SEQ ID NO: 382 - RNA, 19 nt, synthetic construct
  source 1..19: mol_type = other RNA
ttcccttggatgtagtcta

SEQ ID NO: 383 - RNA, 19 nt, synthetic construct
  source 1..19: mol_type = other RNA
ttcccttggatgtagtctt

SEQ ID NO: 384 - RNA, 19 nt, synthetic construct
  source 1..19: mol_type = other RNA
ttcccttggatgtagtctg

SEQ ID NO: 385 - RNA, 19 nt, synthetic construct
  source 1..19: mol_type = other RNA
ttcccttggatgtagtctn

SEQ ID NO: 386 - RNA, 19 nt, synthetic construct
  source 1..19: mol_type = other RNA
ntcccttggatgtagtctn

SEQ ID NO: 387 - RNA, 19 nt, synthetic construct
  source 1..19: mol_type = other RNA
cttaactcatctgttatca

SEQ ID NO: 388 - RNA, 19 nt, synthetic construct
  source 1..19: mol_type = other RNA
cttaactcatctgttatct

SEQ ID NO: 389 - RNA, 19 nt, synthetic construct
  source 1..19: mol_type = other RNA
cttaactcatctgttatcc

SEQ ID NO: 390 - RNA, 19 nt, synthetic construct
  source 1..19: mol_type = other RNA
cttaactcatctgttatcn

SEQ ID NO: 391 - RNA, 19 nt, synthetic construct
  source 1..19: mol_type = other RNA
nttaactcatctgttatcn

SEQ ID NO: 392 - RNA, 19 nt, synthetic construct
  source 1..19: mol_type = other RNA
ttaactcatctgttatcct

SEQ ID NO: 393 - RNA, 19 nt, synthetic construct
  source 1..19: mol_type = other RNA
ttaactcatctgttatcca

SEQ ID NO: 394 - RNA, 19 nt, synthetic construct
  source 1..19: mol_type = other RNA
ttaactcatctgttatccn

SEQ ID NO: 395 - RNA, 19 nt, synthetic construct
  source 1..19: mol_type = other RNA
ntaactcatctgttatccn

SEQ ID NO: 396 - RNA, 19 nt, synthetic construct
  source 1..19: mol_type = other RNA
taactcatctgttatccta

SEQ ID NO: 397 - RNA, 19 nt, synthetic construct
  source 1..19: mol_type = other RNA
taactcatctgttatcctt

SEQ ID NO: 398 - RNA, 19 nt, synthetic construct
  source 1..19: mol_type = other RNA
taactcatctgttatcctg

SEQ ID NO: 399 - RNA, 19 nt, synthetic construct
  source 1..19: mol_type = other RNA
taactcatctgttatcctn

SEQ ID NO: 400 - RNA, 19 nt, synthetic construct
  source 1..19: mol_type = other RNA
naactcatctgttatcctn

SEQ ID NO: 401 - RNA, 19 nt, synthetic construct
  source 1..19: mol_type = other RNA
aactcatctgttatcctga

SEQ ID NO: 402 - RNA, 19 nt, synthetic construct
  source 1..19: mol_type = other RNA
aactcatctgttatcctgt

SEQ ID NO: 403 - RNA, 19 nt, synthetic construct
  source 1..19: mol_type = other RNA
aactcatctgttatcctgc

SEQ ID NO: 404 - RNA, 19 nt, synthetic construct
  source 1..19: mol_type = other RNA
aactcatctgttatcctgn

SEQ ID NO: 405 - RNA, 19 nt, synthetic construct
  source 1..19: mol_type = other RNA
nactcatctgttatcctgn

SEQ ID NO: 406 - RNA, 19 nt, synthetic construct
  source 1..19: mol_type = other RNA
catctgttatcctgctaga

SEQ ID NO: 407 - RNA, 19 nt, synthetic construct
  source 1..19: mol_type = other RNA
catctgttatcctgctagt

SEQ ID NO: 408 - RNA, 19 nt, synthetic construct
  source 1..19: mol_type = other RNA
catctgttatcctgctagc

SEQ ID NO: 409 - RNA, 19 nt, synthetic construct
  source 1..19: mol_type = other RNA
catctgttatcctgctagn

SEQ ID NO: 410 - RNA, 19 nt, synthetic construct
  source 1..19: mol_type = other RNA
natctgttatcctgctagn

SEQ ID NO: 411 - RNA, 19 nt, synthetic construct
  source 1..19: mol_type = other RNA
tctgttatcctgctagcta

SEQ ID NO: 412 - RNA, 19 nt, synthetic construct
  source 1..19: mol_type = other RNA
tctgttatcctgctagctt

SEQ ID NO: 413 - RNA, 19 nt, synthetic construct
  source 1..19: mol_type = other RNA
tctgttatcctgctagctg

SEQ ID NO: 414 - RNA, 19 nt, synthetic construct
  source 1..19: mol_type = other RNA
tctgttatcctgctagctn

SEQ ID NO: 415 - RNA, 19 nt, synthetic construct
  source 1..19: mol_type = other RNA
nctgttatcctgctagctn

SEQ ID NO: 416 - RNA, 19 nt, synthetic construct
  source 1..19: mol_type = other RNA
tatcctgctagctgtagaa

SEQ ID NO: 417 - RNA, 19 nt, synthetic construct
  source 1..19: mol_type = other RNA
tatcctgctagctgtagat

SEQ ID NO: 418 - RNA, 19 nt, synthetic construct
  source 1..19: mol_type = other RNA
tatcctgctagctgtagan

SEQ ID NO: 419 - RNA, 19 nt, synthetic construct
  source 1..19: mol_type = other RNA
natcctgctagctgtagan

SEQ ID NO: 420 - RNA, 19 nt, synthetic construct
  source 1..19: mol_type = other RNA
cctgctagctgtagaaata

SEQ ID NO: 421 - RNA, 19 nt, synthetic construct
  source 1..19: mol_type = other RNA
cctgctagctgtagaaatt

SEQ ID NO: 422 - RNA, 19 nt, synthetic construct
  source 1..19: mol_type = other RNA
cctgctagctgtagaaatg

SEQ ID NO: 423 - RNA, 19 nt, synthetic construct
  source 1..19: mol_type = other RNA
cctgctagctgtagaaatn

SEQ ID NO: 424 - RNA, 19 nt, synthetic construct
  source 1..19: mol_type = other RNA
nctgctagctgtagaaatn

SEQ ID NO: 425 - RNA, 19 nt, synthetic construct
  source 1..19: mol_type = other RNA
tgctagctgtagaaatgta

SEQ ID NO: 426 - RNA, 19 nt, synthetic construct
  source 1..19: mol_type = other RNA
tgctagctgtagaaatgtt

SEQ ID NO: 427 - RNA, 19 nt, synthetic construct
  source 1..19: mol_type = other RNA
tgctagctgtagaaatgtn

SEQ ID NO: 428 - RNA, 19 nt, synthetic construct
  source 1..19: mol_type = other RNA
ngctagctgtagaaatgtn

SEQ ID NO: 429 - RNA, 19 nt, synthetic construct
  source 1..19: mol_type = other RNA
gctagctgtagaaatgtat

SEQ ID NO: 430 - RNA, 19 nt, synthetic construct
  source 1..19: mol_type = other RNA
gctagctgtagaaatgtaa

SEQ ID NO: 431 - RNA, 19 nt, synthetic construct
  source 1..19: mol_type = other RNA
gctagctgtagaaatgtan

SEQ ID NO: 432 - RNA, 19 nt, synthetic construct
  source 1..19: mol_type = other RNA
nctagctgtagaaatgtan

SEQ ID NO: 433 - RNA, 19 nt, synthetic construct
  source 1..19: mol_type = other RNA
tagctgtagaaatgtatca

SEQ ID NO: 434 - RNA, 19 nt, synthetic construct
  source 1..19: mol_type = other RNA
tagctgtagaaatgtatct

SEQ ID NO: 435 - RNA, 19 nt, synthetic construct
  source 1..19: mol_type = other RNA
tagctgtagaaatgtatcc

SEQ ID NO: 436 - RNA, 19 nt, synthetic construct
  source 1..19: mol_type = other RNA
tagctgtagaaatgtatcn

SEQ ID NO: 437 - RNA, 19 nt, synthetic construct
  source 1..19: mol_type = other RNA
nagctgtagaaatgtatcn

SEQ ID NO: 438 - RNA, 19 nt, synthetic construct
  source 1..19: mol_type = other RNA
gctgtagaaatgtatccta

SEQ ID NO: 439 - RNA, 19 nt, synthetic construct
  source 1..19: mol_type = other RNA
gctgtagaaatgtatcctt

SEQ ID NO: 440 - RNA, 19 nt, synthetic construct
  source 1..19: mol_type = other RNA
gctgtagaaatgtatcctg

SEQ ID NO: 441 - RNA, 19 nt, synthetic construct
  source 1..19: mol_type = other RNA
gctgtagaaatgtatcctn

SEQ ID NO: 442 - RNA, 19 nt, synthetic construct
  source 1..19: mol_type = other RNA
nctgtagaaatgtatcctn

SEQ ID NO: 443 - RNA, 19 nt, synthetic construct
  source 1..19: mol_type = other RNA
ctgtagaaatgtatcctga

SEQ ID NO: 444 - RNA, 19 nt, synthetic construct
  source 1..19: mol_type = other RNA
ctgtagaaatgtatcctgt

SEQ ID NO: 445 - RNA, 19 nt, synthetic construct
  source 1..19: mol_type = other RNA
ctgtagaaatgtatcctgn

SEQ ID NO: 446 - RNA, 19 nt, synthetic construct
  source 1..19: mol_type = other RNA
ntgtagaaatgtatcctgn

SEQ ID NO: 447 - RNA, 19 nt, synthetic construct
  source 1..19: mol_type = other RNA
aatgtatcctgataaacat

SEQ ID NO: 448 - RNA, 19 nt, synthetic construct
  source 1..19: mol_type = other RNA
aatgtatcctgataaacaa

SEQ ID NO: 449 - RNA, 19 nt, synthetic construct
  source 1..19: mol_type = other RNA
aatgtatcctgataaacan

SEQ ID NO: 450 - RNA, 19 nt, synthetic construct
  source 1..19: mol_type = other RNA
natgtatcctgataaacan

SEQ ID NO: 451 - RNA, 19 nt, synthetic construct
  source 1..19: mol_type = other RNA
ctgataaacattaaacact

SEQ ID NO: 452 - RNA, 19 nt, synthetic construct
  source 1..19: mol_type = other RNA
ctgataaacattaaacaca

SEQ ID NO: 453 - RNA, 19 nt, synthetic construct
  source 1..19: mol_type = other RNA
ctgataaacattaaacacn

SEQ ID NO: 454 - RNA, 19 nt, synthetic construct
  source 1..19: mol_type = other RNA
ntgataaacattaaacacn

SEQ ID NO: 455 - RNA, 19 nt, synthetic construct
  source 1..19: mol_type = other RNA
acattaaacactgtaatct

SEQ ID NO: 456 - RNA, 19 nt, synthetic construct
  source 1..19: mol_type = other RNA
acattaaacactgtaatca

SEQ ID NO: 457 - RNA, 19 nt, synthetic construct
  source 1..19: mol_type = other RNA
acattaaacactgtaatcn

SEQ ID NO: 458 - RNA, 19 nt, synthetic construct
  source 1..19: mol_type = other RNA
ncattaaacactgtaatcn

SEQ ID NO: 459 - RNA, 19 nt, synthetic construct
  source 1..19: mol_type = other RNA
attaaacactgtaatctta

SEQ ID NO: 460 - RNA, 19 nt, synthetic construct
  source 1..19: mol_type = other RNA
attaaacactgtaatcttt

SEQ ID NO: 461 - RNA, 19 nt, synthetic construct
  source 1..19: mol_type = other RNA
attaaacactgtaatcttn

SEQ ID NO: 462 - RNA, 19 nt, synthetic construct
  source 1..19: mol_type = other RNA
nttaaacactgtaatcttn

SEQ ID NO: 463 - RNA, 19 nt, synthetic construct
  source 1..19: mol_type = other RNA
ctttaaagtacctgtagta

SEQ ID NO: 464 - RNA, 19 nt, synthetic construct
  source 1..19: mol_type = other RNA
ctttaaagtacctgtagtt

SEQ ID NO: 465 - RNA, 19 nt, synthetic construct
  source 1..19: mol_type = other RNA
ctttaaagtacctgtagtg

SEQ ID NO: 466 - RNA, 19 nt, synthetic construct
  source 1..19: mol_type = other RNA
ctttaaagtacctgtagtn

SEQ ID NO: 467 - RNA, 19 nt, synthetic construct
  source 1..19: mol_type = other RNA
ntttaaagtacctgtagtn

SEQ ID NO: 468 - RNA, 19 nt, synthetic construct
  source 1..19: mol_type = other RNA
actgatttatgatcactta

SEQ ID NO: 469 - RNA, 19 nt, synthetic construct
  source 1..19: mol_type = other RNA
actgatttatgatcacttt

SEQ ID NO: 470 - RNA, 19 nt, synthetic construct
  source 1..19: mol_type = other RNA
actgatttatgatcacttg

SEQ ID NO: 471 - RNA, 19 nt, synthetic construct
  source 1..19: mol_type = other RNA
actgatttatgatcacttn

SEQ ID NO: 472 - RNA, 19 nt, synthetic construct
  source 1..19: mol_type = other RNA
nctgatttatgatcacttn

SEQ ID NO: 473 - RNA, 19 nt, synthetic construct
  source 1..19: mol_type = other RNA
atgatcacttggaagattt

SEQ ID NO: 474 - RNA, 19 nt, synthetic construct
  source 1..19: mol_type = other RNA
atgatcacttggaagatta

SEQ ID NO: 475 - RNA, 19 nt, synthetic construct
  source 1..19: mol_type = other RNA
atgatcacttggaagattn

SEQ ID NO: 476 - RNA, 19 nt, synthetic construct
  source 1..19: mol_type = other RNA
ntgatcacttggaagattn

SEQ ID NO: 477 - RNA, 19 nt, synthetic construct
  source 1..19: mol_type = other RNA
atcacttggaagatttgta

SEQ ID NO: 478 - RNA, 19 nt, synthetic construct
  source 1..19: mol_type = other RNA
atcacttggaagatttgtt

SEQ ID NO: 479 - RNA, 19 nt, synthetic construct
  source 1..19: mol_type = other RNA
atcacttggaagatttgtn

SEQ ID NO: 480 - RNA, 19 nt, synthetic construct
  source 1..19: mol_type = other RNA
ntcacttggaagatttgtn

SEQ ID NO: 481 - RNA, 19 nt, synthetic construct
  source 1..19: mol_type = other RNA
tggaagatttgtatagttt

SEQ ID NO: 482 - RNA, 19 nt, synthetic construct
  source 1..19: mol_type = other RNA
tggaagatttgtatagtta

SEQ ID NO: 483 - RNA, 19 nt, synthetic construct
  source 1..19: mol_type = other RNA
tggaagatttgtatagttn

SEQ ID NO: 484 - RNA, 19 nt, synthetic construct
  source 1..19: mol_type = other RNA
nggaagatttgtatagttn

SEQ ID NO: 485 - RNA, 19 nt, synthetic construct
  source 1..19: mol_type = other RNA
gttaaaatgtctgtttcaa

SEQ ID NO: 486 - RNA, 19 nt, synthetic construct
  source 1..19: mol_type = other RNA
gttaaaatgtctgtttcat

SEQ ID NO: 487 - RNA, 19 nt, synthetic construct
  source 1..19: mol_type = other RNA
gttaaaatgtctgtttcan

SEQ ID NO: 488 - RNA, 19 nt, synthetic construct
  source 1..19: mol_type = other RNA
nttaaaatgtctgtttcan

SEQ ID NO: 489 - RNA, 19 nt, synthetic construct
  source 1..19: mol_type = other RNA
atgtctgtttcaatgacct

SEQ ID NO: 490 - RNA, 19 nt, synthetic construct
  source 1..19: mol_type = other RNA
atgtctgtttcaatgacca

SEQ ID NO: 491 - RNA, 19 nt, synthetic construct
  source 1..19: mol_type = other RNA
atgtctgtttcaatgaccn

SEQ ID NO: 492 - RNA, 19 nt, synthetic construct
  source 1..19: mol_type = other RNA
ntgtctgtttcaatgaccn

SEQ ID NO: 493 - RNA, 19 nt, synthetic construct
  source 1..19: mol_type = other RNA
gtttcaatgacctgtattt

SEQ ID NO: 494 - RNA, 19 nt, synthetic construct
  source 1..19: mol_type = other RNA
gtttcaatgacctgtatta

SEQ ID NO: 495 - RNA, 19 nt, synthetic construct
  source 1..19: mol_type = other RNA
gtttcaatgacctgtattn

SEQ ID NO: 496 - RNA, 19 nt, synthetic construct
  source 1..19: mol_type = other RNA
ntttcaatgacctgtattn

SEQ ID NO: 497 - RNA, 19 nt, synthetic construct
  source 1..19: mol_type = other RNA
cctgtattttgccagactt

SEQ ID NO: 498 - RNA, 19 nt, synthetic construct
  source 1..19: mol_type = other RNA
cctgtattttgccagacta

SEQ ID NO: 499 - RNA, 19 nt, synthetic construct
  source 1..19: mol_type = other RNA
cctgtattttgccagactn

SEQ ID NO: 500 - RNA, 19 nt, synthetic construct
  source 1..19: mol_type = other RNA
nctgtattttgccagactn

SEQ ID NO: 501 - RNA, 19 nt, synthetic construct
  source 1..19: mol_type = other RNA
aaatcacagatgggtatta

SEQ ID NO: 502 - RNA, 19 nt, synthetic construct
  source 1..19: mol_type = other RNA
aaatcacagatgggtattt

SEQ ID NO: 503 - RNA, 19 nt, synthetic construct
  source 1..19: mol_type = other RNA
aaatcacagatgggtattn

SEQ ID NO: 504 - RNA, 19 nt, synthetic construct
  source 1..19: mol_type = other RNA
naatcacagatgggtattn

SEQ ID NO: 505 - RNA, 19 nt, synthetic construct
  source 1..19: mol_type = other RNA
acagatgggtattaaactt

SEQ ID NO: 506 - RNA, 19 nt, synthetic construct
  source 1..19: mol_type = other RNA
acagatgggtattaaacta

SEQ ID NO: 507 - RNA, 19 nt, synthetic construct
  source 1..19: mol_type = other RNA
acagatgggtattaaactn

SEQ ID NO: 508 - RNA, 19 nt, synthetic construct
  source 1..19: mol_type = other RNA
ncagatgggtattaaactn

SEQ ID NO: 509 - RNA, 19 nt, synthetic construct
  source 1..19: mol_type = other RNA
cagatgggtattaaactta

SEQ ID NO: 510 - RNA, 19 nt, synthetic construct
  source 1..19: mol_type = other RNA
cagatgggtattaaacttt

SEQ ID NO: 511 - RNA, 19 nt, synthetic construct
  source 1..19: mol_type = other RNA
cagatgggtattaaacttg

SEQ ID NO: 512 - RNA, 19 nt, synthetic construct
  source 1..19: mol_type = other RNA
cagatgggtattaaacttn

SEQ ID NO: 513 - RNA, 19 nt, synthetic construct
  source 1..19: mol_type = other RNA
nagatgggtattaaacttn

SEQ ID NO: 514 - RNA, 19 nt, synthetic construct
  source 1..19: mol_type = other RNA
agatgggtattaaacttgt

SEQ ID NO: 515 - RNA, 19 nt, synthetic construct
  source 1..19: mol_type = other RNA
agatgggtattaaacttga

SEQ ID NO: 516 - RNA, 19 nt, synthetic construct
  source 1..19: mol_type = other RNA
agatgggtattaaacttgn

SEQ ID NO: 517 - RNA, 19 nt, synthetic construct
  source 1..19: mol_type = other RNA
ngatgggtattaaacttgn

SEQ ID NO: 518 - RNA, 19 nt, synthetic construct
  source 1..19: mol_type = other RNA
atgggtattaaacttgtca

SEQ ID NO: 519 - RNA, 19 nt, synthetic construct
  source 1..19: mol_type = other RNA
atgggtattaaacttgtct

SEQ ID NO: 520 - RNA, 19 nt, synthetic construct
  source 1..19: mol_type = other RNA
atgggtattaaacttgtcn

SEQ ID NO: 521 - RNA, 19 nt, synthetic construct
  source 1..19: mol_type = other RNA
ntgggtattaaacttgtcn

SEQ ID NO: 522 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = gm
  modified_base 9: mod_base = gm
  modified_base 10: mod_base = um
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = cm
  modified_base 18: mod_base = OTHER; note = 2'-fluorouridine
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tttcactggtccattactttc

SEQ ID NO: 523 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorouridine
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluoroguanosine
  modified_base 17: mod_base = cm
  modified_base 18: mod_base = OTHER; note = 2'-fluoroadenosine
  modified_base 19: mod_base = gm
  modified_base 20: mod_base = gm
  modified_base 20^21: mod_base = OTHER; note = phosphorothioate linkage
  modified_base 21: mod_base = cm
  source 1..21: mol_type = other RNA
taacatggaatccatgcaggc

SEQ ID NO: 524 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = cm
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = gm
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = um
  source 1..21: mol_type = other RNA
tcaaactcatgaacatggaat

SEQ ID NO: 525 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-O-methyladenosine
  modified_base 9: mod_base = gm
  modified_base 10: mod_base = um
  modified_base 11: mod_base = gm
  modified_base 12: mod_base = OTHER; note = 2'-fluoroadenosine
  modified_base 13: mod_base = gm
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorouridine
  modified_base 19: mod_base = gm
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
tgattaaagtgaggacctgca

SEQ ID NO: 526 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 527 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorouridine
  modified_base 7: mod_base = gm
  modified_base 8: mod_base = cm
  modified_base 9: mod_base = cm
  modified_base 10: mod_base = um
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorouridine
  modified_base 19: mod_base = cm
  modified_base 20: mod_base = cm
  modified_base 20^21: mod_base = OTHER; note = phosphorothioate linkage
  modified_base 21: mod_base = um
  source 1..21: mol_type = other RNA
taacatgcctctcttcatcct

SEQ ID NO: 528 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = cm
  modified_base 8: mod_base = OTHER; note = 2'-O-methyladenosine
  modified_base 9: mod_base = gm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroadenosine
  modified_base 19: mod_base = um
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
agatcacagaatcttcaatag

SEQ ID NO: 529 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = OTHER; note = 2'-fluorocytidine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
tccaattacaccacaagccaa

SEQ ID NO: 530 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorouridine
  modified_base 7: mod_base = cm
  modified_base 8: mod_base = cm
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorouridine
  modified_base 17: mod_base = gm
  modified_base 18: mod_base = OTHER; note = 2'-fluorouridine
  modified_base 19: mod_base = um
  modified_base 20: mod_base = um
  modified_base 20^21: mod_base = OTHER; note = phosphorothioate linkage
  modified_base 21: mod_base = OTHER; note = 2'-O-methyladenosine
  source 1..21: mol_type = other RNA
ttacatccaagggaatgttta

SEQ ID NO: 531 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = OTHER; note = 2'-O-methyladenosine
  modified_base 8: mod_base = cm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = gm
  modified_base 18: mod_base = OTHER; note = 2'-fluoroadenosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = gm
  source 1..21: mol_type = other RNA
tagactacatccaagggaatg

SEQ ID NO: 532 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = OTHER; note = 2'-fluorouridine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 533 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = gm
  modified_base 9: mod_base = cm
  modified_base 10: mod_base = um
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluorouridine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
ttctacagctagcaggataac

SEQ ID NO: 534 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = um
  modified_base 9: mod_base = um
  modified_base 10: mod_base = um
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = cm
  modified_base 18: mod_base = OTHER; note = 2'-fluorouridine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tgatacatttctacagctagc

SEQ ID NO: 535 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = OTHER; note = 2'-O-methyladenosine
  source 1..21: mol_type = other RNA
taggatacatttctacagcta

SEQ ID NO: 536 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorouridine
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
atgtttatcaggatacatttc

SEQ ID NO: 537 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluoroadenosine
  modified_base 19: mod_base = gm
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
agtgtttaatgtttatcagga

SEQ ID NO: 538 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-O-methyladenosine
  modified_base 9: mod_base = gm
  modified_base 10: mod_base = um
  modified_base 11: mod_base = gm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
agattacagtgtttaatgttt

SEQ ID NO: 539 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = gm
  modified_base 9: mod_base = gm
  modified_base 10: mod_base = um
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = gm
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
tactacaggtactttaaagca

SEQ ID NO: 540 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
taagtgatcataaatcagttt

SEQ ID NO: 541 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroadenosine
  modified_base 7: mod_base = um
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroadenosine
  modified_base 13: mod_base = um
  modified_base 14: mod_base = OTHER; note = 2'-fluorocytidine
  modified_base 15: mod_base = um
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
aaactatacaaatcttccaag

SEQ ID NO: 542 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = gm
  modified_base 9: mod_base = gm
  modified_base 10: mod_base = um
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
aaatacaggtcattgaaacag

SEQ ID NO: 543 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluorocytidine
  modified_base 7: mod_base = cm
  modified_base 8: mod_base = cm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorouridine
  modified_base 13: mod_base = gm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = um
  modified_base 18: mod_base = OTHER; note = 2'-fluorouridine
  modified_base 19: mod_base = um
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
taatacccatctgtgatttaa

SEQ ID NO: 544 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = gm
  modified_base 8: mod_base = um
  modified_base 9: mod_base = um
  modified_base 10: mod_base = um
  modified_base 11: mod_base = OTHER; note = 2'-O-methyladenosine
  modified_base 12: mod_base = OTHER; note = 2'-fluoroadenosine
  modified_base 13: mod_base = um
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = um
  modified_base 20: mod_base = cm
  modified_base 20^21: mod_base = OTHER; note = phosphorothioate linkage
  modified_base 21: mod_base = um
  source 1..21: mol_type = other RNA
tgacaagtttaatacccatct

SEQ ID NO: 545 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroadenosine
  modified_base 7: mod_base = cm
  modified_base 8: mod_base = um
  modified_base 9: mod_base = um
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = gm
  modified_base 18: mod_base = OTHER; note = 2'-fluorocytidine
  modified_base 19: mod_base = um
  modified_base 20: mod_base = cm
  modified_base 20^21: mod_base = OTHER; note = phosphorothioate linkage
  modified_base 21: mod_base = gm
  source 1..21: mol_type = other RNA
tcattactttccttctgctcg

SEQ ID NO: 546 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluoroadenosine
  modified_base 7: mod_base = um
  modified_base 8: mod_base = gm
  modified_base 9: mod_base = gm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = gm
  modified_base 18: mod_base = OTHER; note = 2'-fluorocytidine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgaacatggaatccatgcagg

SEQ ID NO: 547 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorouridine
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 548 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = um
  modified_base 9: mod_base = cm
  modified_base 10: mod_base = um
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = gm
  source 1..21: mol_type = other RNA
aaagtcatctgctttttcatg

SEQ ID NO: 549 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = um
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = um
  source 1..21: mol_type = other RNA
aatttctacagctagcaggat

SEQ ID NO: 550 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = cm
  modified_base 9: mod_base = um
  modified_base 10: mod_base = um
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = gm
  modified_base 18: mod_base = OTHER; note = 2'-fluoroadenosine
  modified_base 19: mod_base = um
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
aacaaatcttccaagtgatca

SEQ ID NO: 551 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = um
  modified_base 10: mod_base = OTHER; note = 2'-O-methyladenosine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
aagtttaatacccatctgtga

SEQ ID NO: 552 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 553 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tgatagaggattaaagtgagc

SEQ ID NO: 554 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
tgatagaggattaaagtgagc

SEQ ID NO: 555 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 556 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 557 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 558 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 559 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  source 1..19: mol_type = other RNA
tgatagaggattaaagtga

SEQ ID NO: 560 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 561 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 562 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-fluoroadenosine
  modified_base 9: mod_base = OTHER; note = 2'-fluorocytidine
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 563 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2-aminoadenosine nucleotide
  modified_base 20^21: mod_base = OTHER; note = phosphorothioate linkage
  modified_base 21: mod_base = gm
  source 1..21: mol_type = other RNA
taggataacagatgagttaag

SEQ ID NO: 564 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2-aminoadenosine nucleotide
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 565 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
taggataacagatgagttagg

SEQ ID NO: 566 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 567 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 568 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 18^19: mod_base = OTHER; note = phosphorothioate linkage
  modified_base 19: mod_base = OTHER; note = 2-aminoadenosine nucleotide
  source 1..19: mol_type = other RNA
taggataacagatgagtta

SEQ ID NO: 569 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 18^19: mod_base = OTHER; note = phosphorothioate linkage
  modified_base 19: mod_base = OTHER; note = 2'-O-methyladenosine
  source 1..19: mol_type = other RNA
tgatagaggattaaagtga

SEQ ID NO: 570 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 18^19: mod_base = OTHER; note = phosphorothioate linkage
  modified_base 18^19: mod_base = OTHER; note = phosphorothioate linkage
  modified_base 19: mod_base = OTHER; note = 2'-O-methyladenosine
  source 1..19: mol_type = other RNA
tgatagaggattaaagtga

SEQ ID NO: 571 - RNA, 19 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 18^19: mod_base = OTHER; note = phosphorothioate linkage
  modified_base 18^19: mod_base = OTHER; note = phosphorothioate linkage
  modified_base 19: mod_base = OTHER; note = 2'-O-methyladenosine
  source 1..19: mol_type = other RNA
tgatagaggattaaagtga

SEQ ID NO: 572 - RNA, 19 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-fluoroadenosine
  modified_base 6: mod_base = gm
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 18^19: mod_base = OTHER; note = phosphorothioate linkage
  modified_base 18^19: mod_base = OTHER; note = phosphorothioate linkage
  modified_base 19: mod_base = OTHER; note = 2'-O-methyladenosine
  source 1..19: mol_type = other RNA
tgatagaggattaaagtga

SEQ ID NO: 573 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 574 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = OTHER; note = 2'-fluorouridine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 575 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 576 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 577 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 578 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 579 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-fluoroadenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 580 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 581 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 582 - RNA, 19 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 18^19: mod_base = OTHER; note = phosphorothioate linkage
  modified_base 18^19: mod_base = OTHER; note = phosphorothioate linkage
  modified_base 19: mod_base = OTHER; note = 2'-O-methyladenosine
  source 1..19: mol_type = other RNA
tgatagaggattaaagtga

SEQ ID NO: 583 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 584 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-fluoroadenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 585 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = gm
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 586 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2-aminoadenosine nucleotide
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 587 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 588 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 589 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 590 - RNA, 19 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 18^19: mod_base = OTHER; note = phosphorothioate linkage
  modified_base 18^19: mod_base = OTHER; note = phosphorothioate linkage
  modified_base 19: mod_base = OTHER; note = 2'-O-methyladenosine
  source 1..19: mol_type = other RNA
taggataacagatgagtta

SEQ ID NO: 591 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = um
  modified_base 7: mod_base = um
  modified_base 8: mod_base = cm
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = cm
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
ttactttcttcatttccacct

SEQ ID NO: 592 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 593 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 594 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 595 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
tgatagaggattaaagtgagc

SEQ ID NO: 596 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 597 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroadenosine
  modified_base 8: mod_base = gm
  modified_base 9: mod_base = OTHER; note = 2'-fluoroguanosine
  modified_base 10: mod_base = OTHER; note = 2'-O-methyladenosine
  modified_base 11: mod_base = um
  modified_base 12: mod_base = um
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 598 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroadenosine
  modified_base 8: mod_base = gm
  modified_base 9: mod_base = OTHER; note = 2'-fluoroguanosine
  modified_base 10: mod_base = OTHER; note = 2'-O-methyladenosine
  modified_base 11: mod_base = um
  modified_base 12: mod_base = um
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
tgatagaggattaaagtgagc

SEQ ID NO: 599 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
taggataacagatgagttaac

SEQ ID NO: 600 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 601 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taggataacagatgagttaag

SEQ ID NO: 602 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = gm
  modified_base 5: mod_base = OTHER; note = 2'-fluoroadenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 603 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = gm
  modified_base 5: mod_base = OTHER; note = 2'-fluoroadenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
taggataacagatgagttaac

SEQ ID NO: 604 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = gm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 605 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = gm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
taggataacagatgagttaac

SEQ ID NO: 606 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = gm
  modified_base 5: mod_base = OTHER; note = 2'-fluoroadenosine
  modified_base 6: mod_base = um
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 607 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 608 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 609 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-fluoroadenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 610 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroguanosine
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 611 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2 ,3 -seco-adenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 612 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = OTHER; note = 2 ,3 -seco-guanosine
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 613 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2 ,3 -seco-adenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 614 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-fluoroguanosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgataggggattaaagtgagg

SEQ ID NO: 615 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = OTHER; note = 2 ,3 -seco-guanosine
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 616 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = gm
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 617 - RNA, 21 nt, synthetic construct
  modified_base 1: mod_base = um
  modified_base 1^2: mod_base = OTHER; note = phosphorothioate linkage
  modified_base 2: mod_base = gm
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 618 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = gm
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = um
  modified_base 5: mod_base = OTHER; note = 2'-fluoroadenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 619 - RNA, 21 nt, synthetic construct
  modified_base 1: mod_base = um
  modified_base 1^2: mod_base = OTHER; note = phosphorothioate linkage
  modified_base 2: mod_base = gm
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = OTHER; note = 2'-fluoroadenosine
  modified_base 6: mod_base = gm
  modified_base 7: mod_base = OTHER; note = 2'-fluoroadenosine
  modified_base 8: mod_base = gm
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatagaggattaaagtgagg

SEQ ID NO: 620 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2 ,3 -seco-adenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 621 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2'-O-methyladenosine
  modified_base 6: mod_base = OTHER; note = 2 ,3 -seco-uridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 622 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2 ,3 -seco-adenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 623 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluoroadenosine
  modified_base 3: mod_base = gm
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2 ,3 -seco-adenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
taggataacagatgagttaag

SEQ ID NO: 624 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorouridine
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 625 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = OTHER; note = 2'-O-methyladenosine
  modified_base 8: mod_base = cm
  modified_base 9: mod_base = OTHER; note = 2'-O-methyladenosine
  modified_base 10: mod_base = gm
  modified_base 11: mod_base = OTHER; note = 2'-O-methyladenosine
  modified_base 12: mod_base = OTHER; note = 2'-fluorouridine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tggataacagatgagttaagg

SEQ ID NO: 626 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorocytidine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluorouridine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tctagcaggataacagatgag

SEQ ID NO: 627 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorouridine
  modified_base 7: mod_base = um
  modified_base 8: mod_base = um
  modified_base 9: mod_base = cm
  modified_base 10: mod_base = um
  modified_base 11: mod_base = OTHER; note = 2'-O-methyladenosine
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = cm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
ttacatttctacagctagcag

SEQ ID NO: 628 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluoroadenosine
  modified_base 19: mod_base = gm
  modified_base 20: mod_base = gm
  modified_base 20^21: mod_base = OTHER; note = phosphorothioate linkage
  modified_base 21: mod_base = gm
  source 1..21: mol_type = other RNA
tgtgtttaatgtttatcaggg

SEQ ID NO: 629 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroadenosine
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
taagattacagtgtttaatgc

SEQ ID NO: 630 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = cm
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = um
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluoroadenosine
  modified_base 19: mod_base = um
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
taatcttccaagtgatcatag

SEQ ID NO: 631 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = gm
  modified_base 8: mod_base = gm
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 20^21: mod_base = OTHER; note = phosphorothioate linkage
  modified_base 21: mod_base = cm
  source 1..21: mol_type = other RNA
tagtctggcaaaatacaggtc

SEQ ID NO: 632 - RNA, 21 nt, synthetic construct
  modified_base 1: mod_base = OTHER; note = 5 -cyclopropyl phosphonate-2 -O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = um
  modified_base 9: mod_base = gm
  modified_base 10: mod_base = gm
  modified_base 11: mod_base = OTHER; note = 2'-O-methyladenosine
  modified_base 12: mod_base = OTHER; note = 2'-fluoroadenosine
  modified_base 13: mod_base = um
  modified_base 14: mod_base = OTHER; note = 2'-fluorocytidine
  modified_base 15: mod_base = cm
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
atgaacatggaatccatgcag

SEQ ID NO: 633 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = um
  modified_base 8: mod_base = cm
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluoroadenosine
  modified_base 17: mod_base = cm
  modified_base 18: mod_base = OTHER; note = 2'-fluorocytidine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = um
  source 1..21: mol_type = other RNA
tctttttcatggaccaccagt

SEQ ID NO: 634 - RNA, 21 nt, synthetic construct
  modified_base 1: mod_base = OTHER; note = 5 -cyclopropyl phosphonate-2 -O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = um
  modified_base 8: mod_base = cm
  modified_base 9: mod_base = um
  modified_base 10: mod_base = gm
  modified_base 11: mod_base = cm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = cm
  modified_base 18: mod_base = OTHER; note = 2'-fluoroadenosine
  modified_base 19: mod_base = um
  modified_base 20: mod_base = gm
  modified_base 20^21: mod_base = OTHER; note = phosphorothioate linkage
  modified_base 21: mod_base = gm
  source 1..21: mol_type = other RNA
aagtcatctgctttttcatgg

SEQ ID NO: 635 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluorouridine
  modified_base 7: mod_base = um
  modified_base 8: mod_base = cm
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = cm
  modified_base 20: mod_base = cm
  modified_base 20^21: mod_base = OTHER; note = phosphorothioate linkage
  modified_base 21: mod_base = um
  source 1..21: mol_type = other RNA
ttactttcttcatttccacct

SEQ ID NO: 636 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-O-methyladenosine
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroadenosine
  modified_base 19: mod_base = gm
  modified_base 20: mod_base = gm
  modified_base 20^21: mod_base = OTHER; note = phosphorothioate linkage
  modified_base 21: mod_base = gm
  source 1..21: mol_type = other RNA
tgataacagatgagttaaggg

SEQ ID NO: 637 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = gm
  modified_base 6: mod_base = OTHER; note = 2'-fluoroadenosine
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = cm
  modified_base 11: mod_base = OTHER; note = 2'-O-methyladenosine
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = um
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tcaggataacagatgagttag

SEQ ID NO: 638 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroadenosine
  modified_base 7: mod_base = gm
  modified_base 8: mod_base = cm
  modified_base 9: mod_base = OTHER; note = 2'-O-methyladenosine
  modified_base 10: mod_base = gm
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = gm
  source 1..21: mol_type = other RNA
tagctagcaggataacagatg

SEQ ID NO: 639 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluorouridine
  modified_base 7: mod_base = um
  modified_base 8: mod_base = cm
  modified_base 9: mod_base = um
  modified_base 10: mod_base = OTHER; note = 2'-O-methyladenosine
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorocytidine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tacatttctacagctagcagg

SEQ ID NO: 640 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-O-methyladenosine
  modified_base 9: mod_base = gm
  modified_base 10: mod_base = OTHER; note = 2'-O-methyladenosine
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroadenosine
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
ttgaaacagacattttaactg

SEQ ID NO: 641 - RNA, 21 nt, synthetic construct
  modified_base 1: mod_base = OTHER; note = 5 -cyclopropyl phosphonate-2 -O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = um
  modified_base 8: mod_base = um
  modified_base 9: mod_base = gm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-fluoroadenosine
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
aggtcattgaaacagacattc

SEQ ID NO: 642 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = um
  modified_base 11: mod_base = OTHER; note = 2'-O-methyladenosine
  modified_base 12: mod_base = OTHER; note = 2'-fluorocytidine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluorouridine
  modified_base 19: mod_base = gm
  modified_base 20: mod_base = um
  modified_base 20^21: mod_base = OTHER; note = phosphorothioate linkage
  modified_base 21: mod_base = gm
  source 1..21: mol_type = other RNA
taagtttaatacccatctgtg

SEQ ID NO: 643 - RNA, 21 nt, synthetic construct
  modified_base 1: mod_base = OTHER; note = 5 -cyclopropyl phosphonate-2 -O-methyladenosine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorouridine
  modified_base 7: mod_base = um
  modified_base 8: mod_base = um
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluoroadenosine
  modified_base 17: mod_base = um
  modified_base 18: mod_base = OTHER; note = 2'-fluorocytidine
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
acaagtttaatacccatctgc

SEQ ID NO: 644 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 645 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 646 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 647 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 648 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2 ,3 -seco-cytidine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 649 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2 ,3 -seco-uridine
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 650 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = OTHER; note = 2'-fluorocytidine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 651 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgagatcacagaatcttcaac

SEQ ID NO: 652 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 653 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = um
  modified_base 7: mod_base = um
  modified_base 8: mod_base = um
  modified_base 9: mod_base = cm
  modified_base 10: mod_base = um
  modified_base 11: mod_base = um
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = gm
  modified_base 18: mod_base = OTHER; note = 2'-fluoroadenosine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other RNA
tcatgtttcttagagtgagga

SEQ ID NO: 654 - RNA, 20 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 15^16: mod_base = OTHER; note = phosphorothioate linkage
  modified_base 16: mod_base = OTHER; note = 2'-fluoroadenosine
  modified_base 16^17: mod_base = OTHER; note = phosphorothioate linkage
  modified_base 17: mod_base = OTHER; note = 2'-O-methyladenosine
  modified_base 17^18: mod_base = OTHER; note = phosphorothioate linkage
  modified_base 18: mod_base = OTHER; note = 2'-fluoroadenosine
  modified_base 18^19: mod_base = OTHER; note = phosphorothioate linkage
  modified_base 19: mod_base = OTHER; note = 2'-O-methyladenosine
  modified_base 19^20: mod_base = OTHER; note = phosphorothioate linkage
  modified_base 20: mod_base = um
  source 1..20: mol_type = other RNA
tttagagtgaggattaaaat

SEQ ID NO: 655 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluorouridine
  modified_base 3: mod_base = um
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 656 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 657 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-O-methyladenosine
  modified_base 7: mod_base = gm
  modified_base 8: mod_base = gm
  modified_base 9: mod_base = gm
  modified_base 10: mod_base = um
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = um
  source 1..21: mol_type = other RNA
ttttgagggtagcagatgagt

SEQ ID NO: 658 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = um
  source 1..21: mol_type = other RNA
tacaactcttcagattacagt

SEQ ID NO: 659 - RNA, 21 nt, synthetic construct
  modified_base 1: mod_base = OTHER; note = 5 -cyclopropyl phosphonate-2 -O-methyluridine
  modified_base 2: mod_base = OTHER; note = 2'-fluorouridine
  modified_base 3: mod_base = um
  modified_base 4: mod_base = OTHER; note = 2'-fluoroadenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 660 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-O-methyladenosine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluorouridine
  modified_base 9: mod_base = OTHER; note = 2'-fluoroguanosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 661 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 662 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-fluoroadenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 663 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = um
  modified_base 7: mod_base = um
  modified_base 8: mod_base = um
  modified_base 9: mod_base = OTHER; note = 2'-O-methyladenosine
  modified_base 10: mod_base = OTHER; note = 2'-fluoroadenosine
  modified_base 11: mod_base = um
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = gm
  modified_base 18: mod_base = OTHER; note = 2'-O-methyladenosine
  modified_base 19: mod_base = gm
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tacagtttaatggtttgaggg

SEQ ID NO: 664 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = um
  modified_base 7: mod_base = um
  modified_base 8: mod_base = um
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = gm
  modified_base 18: mod_base = OTHER; note = 2'-fluoroadenosine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
tacagtttaatggtttgaggg

SEQ ID NO: 665 - RNA, 21 nt, synthetic construct
  modified_base 1: mod_base = um
  modified_base 1^2: mod_base = OTHER; note = phosphorothioate linkage
  modified_base 2: mod_base = um
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = gm
  source 1..21: mol_type = other RNA
tttagagtgaggattaaaatg

SEQ ID NO: 666 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = um
  source 1..21: mol_type = other RNA
tcagattacagtttaatggtt

SEQ ID NO: 667 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 668 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluorouridine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
taggattaaaatgaggtcctg

SEQ ID NO: 669 - RNA, 21 nt, synthetic construct
  modified_base 1: mod_base = um
  modified_base 1^2: mod_base = OTHER; note = phosphorothioate linkage
  modified_base 2: mod_base = um
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 670 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = um
  modified_base 7: mod_base = um
  modified_base 8: mod_base = gm
  modified_base 9: mod_base = um
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = um
  source 1..21: mol_type = other RNA
tgtctttgtactttcttcatt

SEQ ID NO: 671 - RNA, 23 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-O-methyladenosine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluorouridine
  modified_base 9: mod_base = OTHER; note = 2'-fluoroguanosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = gm
  modified_base 21^22: mod_base = OTHER; note = phosphorothioate linkage
  modified_base 22: mod_base = OTHER; note = 2'-O-methyladenosine
  modified_base 22^23: mod_base = OTHER; note = phosphorothioate linkage
  modified_base 23: mod_base = gm
  source 1..23: mol_type = other RNA
tttagagtgaggattaaaatgag

SEQ ID NO: 672 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 3: mod_base = um
  modified_base 4: mod_base = OTHER; note = 2'-fluoroadenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 673 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = um
  modified_base 7: mod_base = um
  modified_base 8: mod_base = cm
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = cm
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
ttactttcttcatttccacct

SEQ ID NO: 674 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = cm
  modified_base 7: mod_base = um
  modified_base 8: mod_base = um
  modified_base 9: mod_base = gm
  modified_base 10: mod_base = um
  modified_base 11: mod_base = um
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = gm
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
ttcatcttgtttctcatggac

SEQ ID NO: 675 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = um
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = um
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorouridine
  modified_base 21: mod_base = gm
  source 1..21: mol_type = other RNA
tttagagtgaggattaaaatg

SEQ ID NO: 676 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-O-methyladenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 15^16: mod_base = OTHER; note = phosphorothioate linkage
  modified_base 16: mod_base = OTHER; note = 2'-fluoroadenosine
  modified_base 16^17: mod_base = OTHER; note = phosphorothioate linkage
  modified_base 17: mod_base = OTHER; note = 2'-O-methyladenosine
  modified_base 17^18: mod_base = OTHER; note = phosphorothioate linkage
  modified_base 18: mod_base = OTHER; note = 2'-fluoroadenosine
  modified_base 18^19: mod_base = OTHER; note = phosphorothioate linkage
  modified_base 19: mod_base = OTHER; note = 2'-O-methyladenosine
  modified_base 19^20: mod_base = OTHER; note = phosphorothioate linkage
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 677 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = um
  modified_base 8: mod_base = um
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = gm
  modified_base 18: mod_base = OTHER; note = 2'-O-methyladenosine
  modified_base 19: mod_base = gm
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tacagtttaatggtttgaggg

SEQ ID NO: 678 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-O-methyladenosine
  modified_base 5: mod_base = gm
  modified_base 6: mod_base = um
  modified_base 7: mod_base = um
  modified_base 8: mod_base = um
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = gm
  modified_base 18: mod_base = OTHER; note = 2'-O-methyladenosine
  modified_base 19: mod_base = gm
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tacagtttaatggtttgaggg

SEQ ID NO: 679 - RNA, 21 nt, synthetic construct
  modified_base 1: mod_base = OTHER; note = 5 -cyclopropyl phosphonate-2 -O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluoroadenosine
  modified_base 7: mod_base = gm
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = gm
  source 1..21: mol_type = other RNA
tttagagtgaggattaaaatg

SEQ ID NO: 680 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = gm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluorocytidine
  modified_base 17: mod_base = um
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
taatgatggaatgctctcctg

SEQ ID NO: 681 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gaaagtaatggaccagtgaaa

SEQ ID NO: 682 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = gm
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
gcctgcatggattccatgtta

SEQ ID NO: 683 - RNA, 21 nt, synthetic construct
  modified_base 1: mod_base = OTHER; note = 2'-O-methyladenosine
  modified_base 2: mod_base = um
  modified_base 3: mod_base = um
  modified_base 4: mod_base = cm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
attccatgttcatgagtttga

SEQ ID NO: 684 - RNA, 21 nt, synthetic construct
  modified_base 1: mod_base = um
  modified_base 2: mod_base = gm
  modified_base 3: mod_base = cm
  modified_base 4: mod_base = OTHER; note = 2'-O-methyladenosine
  modified_base 5: mod_base = gm
  modified_base 6: mod_base = gm
  modified_base 7: mod_base = um
  modified_base 8: mod_base = cm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = um
  modified_base 15: mod_base = um
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
tgcaggtcctcactttaatca

SEQ ID NO: 685 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 686 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = OTHER; note = 2'-O-methyladenosine
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
aggatgaagagaggcatgtta

SEQ ID NO: 687 - RNA, 21 nt, synthetic construct
  modified_base 1: mod_base = cm
  modified_base 2: mod_base = um
  modified_base 3: mod_base = OTHER; note = 2'-O-methyladenosine
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = gm
  modified_base 18: mod_base = OTHER; note = 2'-O-methyladenosine
  modified_base 19: mod_base = um
  modified_base 20: mod_base = cm
  modified_base 21: mod_base = um
  source 1..21: mol_type = other RNA
ctattgaagattctgtgatct

SEQ ID NO: 688 - RNA, 21 nt, synthetic construct
  modified_base 1: mod_base = um
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = gm
  modified_base 21: mod_base = OTHER; note = 2'-O-methyladenosine
  source 1..21: mol_type = other RNA
ttggcttgtggtgtaattgga

SEQ ID NO: 689 - RNA, 21 nt, synthetic construct
  modified_base 1: mod_base = um
  modified_base 2: mod_base = OTHER; note = 2-aminoadenosine nucleotide
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = um
  modified_base 14: mod_base = gm
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
taaacattcccttggatgtaa

SEQ ID NO: 690 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = cm
  modified_base 6: mod_base = cm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
cattcccttggatgtagtcta

SEQ ID NO: 691 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 692 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gttatcctgctagctgtagaa

SEQ ID NO: 693 - RNA, 21 nt, synthetic construct
  modified_base 1: mod_base = gm
  modified_base 2: mod_base = cm
  modified_base 3: mod_base = um
  modified_base 4: mod_base = OTHER; note = 2'-O-methyladenosine
  modified_base 5: mod_base = gm
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctagctgtagaaatgtatca

SEQ ID NO: 694 - RNA, 21 nt, synthetic construct
  modified_base 1: mod_base = um
  modified_base 2: mod_base = OTHER; note = 2'-O-methyladenosine
  modified_base 3: mod_base = gm
  modified_base 4: mod_base = cm
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
tagctgtagaaatgtatccta

SEQ ID NO: 695 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = um
  source 1..21: mol_type = other RNA
gaaatgtatcctgataaacat

SEQ ID NO: 696 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
tcctgataaacattaaacact

SEQ ID NO: 697 - RNA, 21 nt, synthetic construct
  modified_base 1: mod_base = OTHER; note = 2-aminoadenosine nucleotide
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = um
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = um
  source 1..21: mol_type = other RNA
aaacattaaacactgtaatct

SEQ ID NO: 698 - RNA, 21 nt, synthetic construct
  modified_base 1: mod_base = um
  modified_base 2: mod_base = gm
  modified_base 3: mod_base = cm
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
tgctttaaagtacctgtagta

SEQ ID NO: 699 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
aaactgatttatgatcactta

SEQ ID NO: 700 - RNA, 21 nt, synthetic construct
  modified_base 1: mod_base = cm
  modified_base 2: mod_base = um
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = gm
  modified_base 19: mod_base = um
  modified_base 20: mod_base = um
  modified_base 21: mod_base = um
  source 1..21: mol_type = other RNA
cttggaagatttgtatagttt

SEQ ID NO: 701 - RNA, 21 nt, synthetic construct
  modified_base 1: mod_base = cm
  modified_base 2: mod_base = um
  modified_base 3: mod_base = gm
  modified_base 4: mod_base = um
  modified_base 5: mod_base = um
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = um
  source 1..21: mol_type = other RNA
ctgtttcaatgacctgtattt

SEQ ID NO: 702 - RNA, 21 nt, synthetic construct
  modified_base 1: mod_base = um
  modified_base 2: mod_base = um
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = gm
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
ttaaatcacagatgggtatta

SEQ ID NO: 703 - RNA, 21 nt, synthetic construct
  modified_base 1: mod_base = OTHER; note = 2-aminoadenosine nucleotide
  modified_base 2: mod_base = gm
  modified_base 3: mod_base = OTHER; note = 2'-O-methyladenosine
  modified_base 4: mod_base = um
  modified_base 5: mod_base = gm
  modified_base 6: mod_base = gm
  modified_base 7: mod_base = gm
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine
  source 1..21: mol_type = other RNA
agatgggtattaaacttgtca

SEQ ID NO: 704 - RNA, 21 nt, synthetic construct
  modified_base 1: mod_base = cm
  modified_base 2: mod_base = gm
  modified_base 3: mod_base = OTHER; note = 2'-O-methyladenosine
  modified_base 4: mod_base = gm
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
cgagcagaaggaaagtaatga

SEQ ID NO: 705 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
cctgcatggattccatgttca

SEQ ID NO: 706 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 707 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 708 - RNA, 21 nt, synthetic construct
  modified_base 1: mod_base = OTHER; note = 2'-O-methyladenosine
  modified_base 2: mod_base = um
  modified_base 3: mod_base = cm
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = um
  source 1..21: mol_type = other RNA
atcctgctagctgtagaaatt

SEQ ID NO: 709 - RNA, 21 nt, synthetic construct
  modified_base 1: mod_base = um
  modified_base 2: mod_base = gm
  modified_base 3: mod_base = OTHER; note = 2-aminoadenosine nucleotide
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = um
  modified_base 19: mod_base = gm
  modified_base 20: mod_base = um
  modified_base 21: mod_base = um
  source 1..21: mol_type = other RNA
tgatcacttggaagatttgtt

SEQ ID NO: 710 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 711 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 712 - RNA, 21 nt, synthetic construct
  modified_base 1: mod_base = cm
  modified_base 2: mod_base = gm
  modified_base 3: mod_base = OTHER; note = 2'-O-methyladenosine
  modified_base 4: mod_base = gm
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
cgagcagaaggaaagtaatga

SEQ ID NO: 713 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
cctgcatggattccatgttca

SEQ ID NO: 714 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 715 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 716 - RNA, 21 nt, synthetic construct
  modified_base 1: mod_base = OTHER; note = 2'-O-methyladenosine
  modified_base 2: mod_base = um
  modified_base 3: mod_base = cm
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = um
  source 1..21: mol_type = other RNA
atcctgctagctgtagaaatt

SEQ ID NO: 717 - RNA, 21 nt, synthetic construct
  modified_base 1: mod_base = um
  modified_base 2: mod_base = gm
  modified_base 3: mod_base = OTHER; note = 2-aminoadenosine nucleotide
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = um
  modified_base 19: mod_base = gm
  modified_base 20: mod_base = um
  modified_base 21: mod_base = um
  source 1..21: mol_type = other RNA
tgatcacttggaagatttgtt

SEQ ID NO: 718 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 719 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = um
  source 1..21: mol_type = other RNA
gaaatgtatcctgataaacat

SEQ ID NO: 720 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 721 - RNA, 19 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = um
  modified_base 6: mod_base = um
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluoroadenosine
  modified_base 10: mod_base = um
  modified_base 11: mod_base = cm
  modified_base 12: mod_base = cm
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = OTHER; note = 2'-O-methyladenosine
  source 1..19: mol_type = other RNA
tcactttaatcctctatca

SEQ ID NO: 722 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 723 - RNA, 21 nt, synthetic construct
  modified_base 1: mod_base = cm
  modified_base 2: mod_base = cm
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cctaactcatctgttatccta

SEQ ID NO: 724 - RNA, 19 nt, synthetic construct
  modified_base 1: mod_base = um
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = OTHER; note = 2'-fluoroadenosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = um
  modified_base 13: mod_base = um
  modified_base 14: mod_base = OTHER; note = 2'-O-methyladenosine
  modified_base 15: mod_base = um
  modified_base 16: mod_base = cm
  modified_base 17: mod_base = cm
  modified_base 18: mod_base = um
  modified_base 19: mod_base = OTHER; note = 2'-O-methyladenosine
  source 1..19: mol_type = other RNA
taactcatctgttatccta

SEQ ID NO: 725 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 726 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
cctcactttaatcctctatta

SEQ ID NO: 727 - RNA, 19 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = um
  modified_base 6: mod_base = um
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluoroadenosine
  modified_base 10: mod_base = um
  modified_base 11: mod_base = cm
  modified_base 12: mod_base = cm
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = OTHER; note = 2'-O-methyladenosine
  source 1..19: mol_type = other RNA
tcactttaatcctctatca

SEQ ID NO: 728 - RNA, 19 nt, synthetic construct
  modified_base 1: mod_base = um
  modified_base 2: mod_base = OTHER; note = 2-aminoadenosine nucleotide
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = OTHER; note = 2'-fluoroadenosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = um
  modified_base 13: mod_base = um
  modified_base 14: mod_base = OTHER; note = 2'-O-methyladenosine
  modified_base 15: mod_base = um
  modified_base 16: mod_base = cm
  modified_base 17: mod_base = cm
  modified_base 18: mod_base = um
  modified_base 19: mod_base = OTHER; note = 2'-O-methyladenosine
  source 1..19: mol_type = other RNA
taactcatctgttatccta

SEQ ID NO: 729 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 730 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 731 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
gttaactcatctgttatccta

SEQ ID NO: 732 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-fluoroadenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = OTHER; note = 2'-fluorouridine
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 733 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 734 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 735 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 736 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 737 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gttatcctgctagctgtagaa

SEQ ID NO: 738 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
tcctgataaacattaaacact

SEQ ID NO: 739 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 740 - RNA, 21 nt, synthetic construct
  modified_base 1: mod_base = cm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = um
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
ccttaactcatctgttatcca

SEQ ID NO: 741 - RNA, 21 nt, synthetic construct
  modified_base 1: mod_base = cm
  modified_base 2: mod_base = um
  modified_base 3: mod_base = cm
  modified_base 4: mod_base = OTHER; note = 2'-O-methyladenosine
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ctcatctgttatcctgctaga

SEQ ID NO: 742 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = um
  modified_base 6: mod_base = OTHER; note = 2'-O-methyladenosine
  modified_base 7: mod_base = gm
  modified_base 8: mod_base = cm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
ctgctagctgtagaaatgtaa

SEQ ID NO: 743 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
ccctgataaacattaaacaca

SEQ ID NO: 744 - RNA, 21 nt, synthetic construct
  modified_base 1: mod_base = gm
  modified_base 2: mod_base = cm
  modified_base 3: mod_base = OTHER; note = 2-aminoadenosine nucleotide
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gcattaaacactgtaatctta

SEQ ID NO: 745 - RNA, 21 nt, synthetic construct
  modified_base 1: mod_base = cm
  modified_base 2: mod_base = um
  modified_base 3: mod_base = OTHER; note = 2-aminoadenosine nucleotide
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
ctatgatcacttggaagatta

SEQ ID NO: 746 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = cm
  modified_base 15: mod_base = cm
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gacctgtattttgccagacta

SEQ ID NO: 747 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = cm
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = um
  modified_base 19: mod_base = cm
  modified_base 20: mod_base = OTHER; note = 2'-O-methyladenosine
  modified_base 21: mod_base = um
  source 1..21: mol_type = other RNA
ctgcatggattccatgttcat

SEQ ID NO: 748 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
actggtggtccatgaaaaaga

SEQ ID NO: 749 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
ccatgaaaaagcagatgactt

SEQ ID NO: 750 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
aggtggaaatgaagaaagtaa

SEQ ID NO: 751 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cccttaactcatctgttatca

SEQ ID NO: 752 - RNA, 21 nt, synthetic construct
  modified_base 1: mod_base = cm
  modified_base 2: mod_base = um
  modified_base 3: mod_base = OTHER; note = 2-aminoadenosine nucleotide
  modified_base 4: mod_base = OTHER; note = 2'-O-methyladenosine
  modified_base 5: mod_base = cm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = gm
  modified_base 13: mod_base = um
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
ctaactcatctgttatcctga

SEQ ID NO: 753 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = cm
  modified_base 5: mod_base = um
  modified_base 6: mod_base = gm
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = cm
  modified_base 16: mod_base = um
  modified_base 17: mod_base = OTHER; note = 2'-O-methyladenosine
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
catctgttatcctgctagtta

SEQ ID NO: 754 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = um
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
cctgctagctgtagaaatgta

SEQ ID NO: 755 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = um
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
cagttaaaatgtctgtttcaa

SEQ ID NO: 756 - RNA, 21 nt, synthetic construct
  modified_base 1: mod_base = gm
  modified_base 2: mod_base = OTHER; note = 2-aminoadenosine nucleotide
  modified_base 3: mod_base = OTHER; note = 2'-O-methyladenosine
  modified_base 4: mod_base = um
  modified_base 5: mod_base = gm
  modified_base 6: mod_base = um
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
gaatgtctgtttcaatgactt

SEQ ID NO: 757 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
cacagatgggtattaaactta

SEQ ID NO: 758 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = um
  modified_base 20: mod_base = gm
  modified_base 21: mod_base = um
  source 1..21: mol_type = other RNA
gcagatgggtattaaacttgt

SEQ ID NO: 759 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 760 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 761 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 762 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 763 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 764 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 765 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 766 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 767 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 768 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 769 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 770 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 771 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 772 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 773 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2 -O-propargyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 774 - RNA, 21 nt, synthetic construct
  modified_base 1: mod_base = gm
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gtccatgagaaacaagatgaa

SEQ ID NO: 775 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 776 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
tcctcactctaagaaacatga

SEQ ID NO: 777 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = OTHER; note = 2'C16 alkoxy uridine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 778 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 779 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 780 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
aggtggaaatgaagaaagtaa

SEQ ID NO: 781 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 782 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = cm
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
actcatctgctaccctcaaaa

SEQ ID NO: 783 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = OTHER; note = 2 -O-propargyluridine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 784 - RNA, 21 nt, synthetic construct
  modified_base 1: mod_base = cm
  modified_base 1^2: mod_base = OTHER; note = phosphorothioate linkage
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 785 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
ccctcaaaccattaaactgta

SEQ ID NO: 786 - RNA, 21 nt, synthetic construct
  modified_base 1: mod_base = cm
  modified_base 1^2: mod_base = OTHER; note = phosphorothioate linkage
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 787 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
aatgaagaaagtacaaagaca

SEQ ID NO: 788 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = OTHER; note = 2'C16 alkoxy uridine
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 789 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
tcctcactctaagaaacatga

SEQ ID NO: 790 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 791 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
ccctcaaaccattaaactgta

SEQ ID NO: 792 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
aggtggaaatgaagaaagtaa

SEQ ID NO: 793 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
actgtaatctgaagagttgta

SEQ ID NO: 794 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
aatgaagaaagtacaaagaca

SEQ ID NO: 795 - RNA, 21 nt, synthetic construct
  modified_base 1: mod_base = gm
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gtccatgagaaacaagatgaa

SEQ ID NO: 796 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
caggagagcattccatcatta

SEQ ID NO: 797 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = OTHER; note = 2'-fluorocytidine
  modified_base 14: mod_base = OTHER; note = 2'-O-methyladenosine
  modified_base 15: mod_base = OTHER; note = 2'-fluorocytidine
  modified_base 16: mod_base = um
  modified_base 17: mod_base = OTHER; note = 2'-fluorocytidine
  modified_base 18: mod_base = um
  modified_base 19: mod_base = OTHER; note = 2'-fluoroadenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 798 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2-aminoadenosine nucleotide
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 799 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2-aminoadenosine nucleotide
  source 1..21: mol_type = other RNA
cattttaatcctcactctaaa

SEQ ID NO: 800 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 801 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 802 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = ALNA
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 803 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 804 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 805 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
actgtaatctgaagagttgta

SEQ ID NO: 806 - RNA, 21 nt, synthetic construct
  modified_base 1: mod_base = cm
  modified_base 1^2: mod_base = OTHER; note = phosphorothioate linkage
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 807 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2 -O-propargyluridine
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 808 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
aaccattaaactgtaatctga

SEQ ID NO: 809 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 810 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 811 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
caggacctcattttaatccta

SEQ ID NO: 812 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 813 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = cm
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
actcatctgctaccctcaaaa

SEQ ID NO: 814 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 815 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2-aminoadenosine nucleotide
  modified_base 21: mod_base = OTHER; note = 2'-O-methyladenosine
  source 1..21: mol_type = other RNA
cattttaatcctcactctaaa

SEQ ID NO: 816 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
aaccattaaactgtaatctga

SEQ ID NO: 817 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
caggacctcattttaatccta

SEQ ID NO: 818 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
caggagagcattccatcatta

SEQ ID NO: 819 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 820 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gaaagtaatggaccagtgaaa

SEQ ID NO: 821 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = gm
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
gcctgcatggattccatgtta

SEQ ID NO: 822 - RNA, 21 nt, synthetic construct
  modified_base 1: mod_base = OTHER; note = 2'-O-methyladenosine
  modified_base 2: mod_base = um
  modified_base 3: mod_base = um
  modified_base 4: mod_base = cm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
attccatgttcatgagtttga

SEQ ID NO: 823 - RNA, 21 nt, synthetic construct
  modified_base 1: mod_base = um
  modified_base 2: mod_base = gm
  modified_base 3: mod_base = cm
  modified_base 4: mod_base = OTHER; note = 2'-O-methyladenosine
  modified_base 5: mod_base = gm
  modified_base 6: mod_base = gm
  modified_base 7: mod_base = um
  modified_base 8: mod_base = cm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = um
  modified_base 15: mod_base = um
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
tgcaggtcctcactttaatca

SEQ ID NO: 824 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 825 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = OTHER; note = 2'-O-methyladenosine
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
aggatgaagagaggcatgtta

SEQ ID NO: 826 - RNA, 21 nt, synthetic construct
  modified_base 1: mod_base = cm
  modified_base 2: mod_base = um
  modified_base 3: mod_base = OTHER; note = 2'-O-methyladenosine
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = gm
  modified_base 18: mod_base = OTHER; note = 2'-O-methyladenosine
  modified_base 19: mod_base = um
  modified_base 20: mod_base = cm
  modified_base 21: mod_base = um
  source 1..21: mol_type = other RNA
ctattgaagattctgtgatct

SEQ ID NO: 827 - RNA, 21 nt, synthetic construct
  modified_base 1: mod_base = um
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = gm
  modified_base 21: mod_base = OTHER; note = 2'-O-methyladenosine
  source 1..21: mol_type = other RNA
ttggcttgtggtgtaattgga

SEQ ID NO: 828 - RNA, 21 nt, synthetic construct
  modified_base 1: mod_base = um
  modified_base 2: mod_base = OTHER; note = 2-aminoadenosine nucleotide
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = um
  modified_base 14: mod_base = gm
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
taaacattcccttggatgtaa

SEQ ID NO: 829 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = cm
  modified_base 6: mod_base = cm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
cattcccttggatgtagtcta

SEQ ID NO: 830 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 831 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gttatcctgctagctgtagaa

SEQ ID NO: 832 - RNA, 21 nt, synthetic construct
  modified_base 1: mod_base = gm
  modified_base 2: mod_base = cm
  modified_base 3: mod_base = um
  modified_base 4: mod_base = OTHER; note = 2'-O-methyladenosine
  modified_base 5: mod_base = gm
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctagctgtagaaatgtatca

SEQ ID NO: 833 - RNA, 21 nt, synthetic construct
  modified_base 1: mod_base = um
  modified_base 2: mod_base = OTHER; note = 2'-O-methyladenosine
  modified_base 3: mod_base = gm
  modified_base 4: mod_base = cm
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
tagctgtagaaatgtatccta

SEQ ID NO: 834 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = um
  source 1..21: mol_type = other RNA
gaaatgtatcctgataaacat

SEQ ID NO: 835 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
tcctgataaacattaaacact

SEQ ID NO: 836 - RNA, 21 nt, synthetic construct
  modified_base 1: mod_base = OTHER; note = 2-aminoadenosine nucleotide
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = um
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = um
  source 1..21: mol_type = other RNA
aaacattaaacactgtaatct

SEQ ID NO: 837 - RNA, 21 nt, synthetic construct
  modified_base 1: mod_base = um
  modified_base 2: mod_base = gm
  modified_base 3: mod_base = cm
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
tgctttaaagtacctgtagta

SEQ ID NO: 838 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
aaactgatttatgatcactta

SEQ ID NO: 839 - RNA, 21 nt, synthetic construct
  modified_base 1: mod_base = cm
  modified_base 2: mod_base = um
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = gm
  modified_base 19: mod_base = um
  modified_base 20: mod_base = um
  modified_base 21: mod_base = um
  source 1..21: mol_type = other RNA
cttggaagatttgtatagttt

SEQ ID NO: 840 - RNA, 21 nt, synthetic construct
  modified_base 1: mod_base = cm
  modified_base 2: mod_base = um
  modified_base 3: mod_base = gm
  modified_base 4: mod_base = um
  modified_base 5: mod_base = um
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = um
  source 1..21: mol_type = other RNA
ctgtttcaatgacctgtattt

SEQ ID NO: 841 - RNA, 21 nt, synthetic construct
  modified_base 1: mod_base = um
  modified_base 2: mod_base = um
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = gm
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
ttaaatcacagatgggtatta

SEQ ID NO: 842 - RNA, 21 nt, synthetic construct
  modified_base 1: mod_base = OTHER; note = 2-aminoadenosine nucleotide
  modified_base 2: mod_base = gm
  modified_base 3: mod_base = OTHER; note = 2'-O-methyladenosine
  modified_base 4: mod_base = um
  modified_base 5: mod_base = gm
  modified_base 6: mod_base = gm
  modified_base 7: mod_base = gm
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine
  source 1..21: mol_type = other RNA
agatgggtattaaacttgtca

SEQ ID NO: 843 - RNA, 21 nt, synthetic construct
  modified_base 1: mod_base = cm
  modified_base 2: mod_base = gm
  modified_base 3: mod_base = OTHER; note = 2'-O-methyladenosine
  modified_base 4: mod_base = gm
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
cgagcagaaggaaagtaatga

SEQ ID NO: 844 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
cctgcatggattccatgttca

SEQ ID NO: 845 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 846 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 847 - RNA, 21 nt, synthetic construct
  modified_base 1: mod_base = OTHER; note = 2'-O-methyladenosine
  modified_base 2: mod_base = um
  modified_base 3: mod_base = cm
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = um
  source 1..21: mol_type = other RNA
atcctgctagctgtagaaatt

SEQ ID NO: 848 - RNA, 21 nt, synthetic construct
  modified_base 1: mod_base = um
  modified_base 2: mod_base = gm
  modified_base 3: mod_base = OTHER; note = 2-aminoadenosine nucleotide
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = um
  modified_base 19: mod_base = gm
  modified_base 20: mod_base = um
  modified_base 21: mod_base = um
  source 1..21: mol_type = other RNA
tgatcacttggaagatttgtt

SEQ ID NO: 849 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 850 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 851 - RNA, 21 nt, synthetic construct
  modified_base 1: mod_base = cm
  modified_base 2: mod_base = gm
  modified_base 3: mod_base = OTHER; note = 2'-O-methyladenosine
  modified_base 4: mod_base = gm
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
cgagcagaaggaaagtaatga

SEQ ID NO: 852 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
cctgcatggattccatgttca

SEQ ID NO: 853 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 854 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 855 - RNA, 21 nt, synthetic construct
  modified_base 1: mod_base = OTHER; note = 2'-O-methyladenosine
  modified_base 2: mod_base = um
  modified_base 3: mod_base = cm
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = um
  source 1..21: mol_type = other RNA
atcctgctagctgtagaaatt

SEQ ID NO: 856 - RNA, 21 nt, synthetic construct
  modified_base 1: mod_base = um
  modified_base 2: mod_base = gm
  modified_base 3: mod_base = OTHER; note = 2-aminoadenosine nucleotide
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = um
  modified_base 19: mod_base = gm
  modified_base 20: mod_base = um
  modified_base 21: mod_base = um
  source 1..21: mol_type = other RNA
tgatcacttggaagatttgtt

SEQ ID NO: 857 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 858 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = um
  source 1..21: mol_type = other RNA
gaaatgtatcctgataaacat

SEQ ID NO: 859 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 860 - RNA, 19 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = um
  modified_base 6: mod_base = um
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluoroadenosine
  modified_base 10: mod_base = um
  modified_base 11: mod_base = cm
  modified_base 12: mod_base = cm
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = OTHER; note = 2'-O-methyladenosine
  source 1..19: mol_type = other RNA
tcactttaatcctctatca

SEQ ID NO: 861 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 862 - RNA, 21 nt, synthetic construct
  modified_base 1: mod_base = cm
  modified_base 2: mod_base = cm
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cctaactcatctgttatccta

SEQ ID NO: 863 - RNA, 19 nt, synthetic construct
  modified_base 1: mod_base = um
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = OTHER; note = 2'-fluoroadenosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = um
  modified_base 13: mod_base = um
  modified_base 14: mod_base = OTHER; note = 2'-O-methyladenosine
  modified_base 15: mod_base = um
  modified_base 16: mod_base = cm
  modified_base 17: mod_base = cm
  modified_base 18: mod_base = um
  modified_base 19: mod_base = OTHER; note = 2'-O-methyladenosine
  source 1..19: mol_type = other RNA
taactcatctgttatccta

SEQ ID NO: 864 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = OTHER; note = 2'C16 alkoxy uridine
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 865 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = OTHER; note = 2'C16 alkoxy uridine
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 866 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 867 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
cctcactttaatcctctatta

SEQ ID NO: 868 - RNA, 19 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = um
  modified_base 6: mod_base = um
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluoroadenosine
  modified_base 10: mod_base = um
  modified_base 11: mod_base = cm
  modified_base 12: mod_base = cm
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = OTHER; note = 2'-O-methyladenosine
  source 1..19: mol_type = other RNA
tcactttaatcctctatca

SEQ ID NO: 869 - RNA, 19 nt, synthetic construct
  modified_base 1: mod_base = um
  modified_base 2: mod_base = OTHER; note = 2-aminoadenosine nucleotide
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = OTHER; note = 2'-fluoroadenosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = um
  modified_base 13: mod_base = um
  modified_base 14: mod_base = OTHER; note = 2'-O-methyladenosine
  modified_base 15: mod_base = um
  modified_base 16: mod_base = cm
  modified_base 17: mod_base = cm
  modified_base 18: mod_base = um
  modified_base 19: mod_base = OTHER; note = 2'-O-methyladenosine
  source 1..19: mol_type = other RNA
taactcatctgttatccta

SEQ ID NO: 870 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 871 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 872 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
gttaactcatctgttatccta

SEQ ID NO: 873 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-fluoroadenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = OTHER; note = 2'-fluorouridine
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 874 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 875 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 876 - RNA, 21 nt, synthetic construct
  modified_base 1: mod_base = cm
  modified_base 2: mod_base = cm
  modified_base 3: mod_base = OTHER; note = 2'C16 alkoxy uridine
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 877 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'C16 alkoxy uridine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 878 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = OTHER; note = 2'C16 alkoxy uridine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 879 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = OTHER; note = 2'C16 alkoxy uridine
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 880 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = OTHER; note = 2'C16 alkoxy uridine
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 881 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = OTHER; note = 2'C16 alkoxy uridine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 882 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 883 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 884 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gttatcctgctagctgtagaa

SEQ ID NO: 885 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
tcctgataaacattaaacact

SEQ ID NO: 886 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = OTHER; note = 2'C16 alkoxy uridine
  modified_base 21: mod_base = OTHER; note = 2'-O-methyladenosine
  source 1..21: mol_type = other RNA
cttaactcatctgttatccta

SEQ ID NO: 887 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = OTHER; note = 2'C16 alkoxy uridine
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 888 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'C16 alkoxy uridine
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 889 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = OTHER; note = 2'C16 alkoxy uridine
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 890 - RNA, 21 nt, synthetic construct
  modified_base 1: mod_base = cm
  modified_base 2: mod_base = um
  modified_base 3: mod_base = OTHER; note = 2'C16 alkoxy uridine
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 891 - RNA, 21 nt, synthetic construct
  modified_base 1: mod_base = cm
  modified_base 2: mod_base = OTHER; note = 2'C16 alkoxy uridine
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 892 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 893 - RNA, 21 nt, synthetic construct
  modified_base 1: mod_base = cm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = um
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
ccttaactcatctgttatcca

SEQ ID NO: 894 - RNA, 21 nt, synthetic construct
  modified_base 1: mod_base = cm
  modified_base 2: mod_base = um
  modified_base 3: mod_base = cm
  modified_base 4: mod_base = OTHER; note = 2'-O-methyladenosine
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ctcatctgttatcctgctaga

SEQ ID NO: 895 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = um
  modified_base 6: mod_base = OTHER; note = 2'-O-methyladenosine
  modified_base 7: mod_base = gm
  modified_base 8: mod_base = cm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
ctgctagctgtagaaatgtaa

SEQ ID NO: 896 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
ccctgataaacattaaacaca

SEQ ID NO: 897 - RNA, 21 nt, synthetic construct
  modified_base 1: mod_base = gm
  modified_base 2: mod_base = cm
  modified_base 3: mod_base = OTHER; note = 2-aminoadenosine nucleotide
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gcattaaacactgtaatctta

SEQ ID NO: 898 - RNA, 21 nt, synthetic construct
  modified_base 1: mod_base = cm
  modified_base 2: mod_base = um
  modified_base 3: mod_base = OTHER; note = 2-aminoadenosine nucleotide
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
ctatgatcacttggaagatta

SEQ ID NO: 899 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = cm
  modified_base 15: mod_base = cm
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gacctgtattttgccagacta

SEQ ID NO: 900 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = cm
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = um
  modified_base 19: mod_base = cm
  modified_base 20: mod_base = OTHER; note = 2'-O-methyladenosine
  modified_base 21: mod_base = um
  source 1..21: mol_type = other RNA
ctgcatggattccatgttcat

SEQ ID NO: 901 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
actggtggtccatgaaaaaga

SEQ ID NO: 902 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
ccatgaaaaagcagatgactt

SEQ ID NO: 903 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
aggtggaaatgaagaaagtaa

SEQ ID NO: 904 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cccttaactcatctgttatca

SEQ ID NO: 905 - RNA, 21 nt, synthetic construct
  modified_base 1: mod_base = cm
  modified_base 2: mod_base = um
  modified_base 3: mod_base = OTHER; note = 2-aminoadenosine nucleotide
  modified_base 4: mod_base = OTHER; note = 2'-O-methyladenosine
  modified_base 5: mod_base = cm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = gm
  modified_base 13: mod_base = um
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
ctaactcatctgttatcctga

SEQ ID NO: 906 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = cm
  modified_base 5: mod_base = um
  modified_base 6: mod_base = gm
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = cm
  modified_base 16: mod_base = um
  modified_base 17: mod_base = OTHER; note = 2'-O-methyladenosine
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
catctgttatcctgctagtta

SEQ ID NO: 907 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = um
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
cctgctagctgtagaaatgta

SEQ ID NO: 908 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = um
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
cagttaaaatgtctgtttcaa

SEQ ID NO: 909 - RNA, 21 nt, synthetic construct
  modified_base 1: mod_base = gm
  modified_base 2: mod_base = OTHER; note = 2-aminoadenosine nucleotide
  modified_base 3: mod_base = OTHER; note = 2'-O-methyladenosine
  modified_base 4: mod_base = um
  modified_base 5: mod_base = gm
  modified_base 6: mod_base = um
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
gaatgtctgtttcaatgactt

SEQ ID NO: 910 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
cacagatgggtattaaactta

SEQ ID NO: 911 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = um
  modified_base 20: mod_base = gm
  modified_base 21: mod_base = um
  source 1..21: mol_type = other RNA
gcagatgggtattaaacttgt

SEQ ID NO: 912 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 913 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 914 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 915 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 916 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 917 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 918 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 919 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 920 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 921 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 922 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 923 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 924 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 925 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = OTHER; note = 2 -O-methylcytidine with internal C16
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 926 - RNA, 22 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cctcactttaatcctctatcat

SEQ ID NO: 927 - RNA, 22 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2 -O-propargyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cattttaatcctcactctaaat

SEQ ID NO: 928 - RNA, 21 nt, synthetic construct
  modified_base 1: mod_base = gm
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gtccatgagaaacaagatgaa

SEQ ID NO: 929 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 930 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
tcctcactctaagaaacatga

SEQ ID NO: 931 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = OTHER; note = 2'C16 alkoxy uridine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 932 - RNA, 22 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cattttaatcctcactctaaat

SEQ ID NO: 933 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 934 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
aggtggaaatgaagaaagtaa

SEQ ID NO: 935 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 936 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = cm
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
actcatctgctaccctcaaaa

SEQ ID NO: 937 - RNA, 22 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = OTHER; note = 2 -O-propargyluridine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cattttaatcctcactctaaat

SEQ ID NO: 938 - RNA, 21 nt, synthetic construct
  modified_base 1: mod_base = cm
  modified_base 1^2: mod_base = OTHER; note = phosphorothioate linkage
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 939 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
ccctcaaaccattaaactgta

SEQ ID NO: 940 - RNA, 22 nt, synthetic construct
  modified_base 1: mod_base = cm
  modified_base 1^2: mod_base = OTHER; note = phosphorothioate linkage
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cattttaatcctcactctaaat

SEQ ID NO: 941 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
aatgaagaaagtacaaagaca

SEQ ID NO: 942 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = OTHER; note = 2'C16 alkoxy uridine
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 943 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
tcctcactctaagaaacatga

SEQ ID NO: 944 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 945 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
ccctcaaaccattaaactgta

SEQ ID NO: 946 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
aggtggaaatgaagaaagtaa

SEQ ID NO: 947 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
actgtaatctgaagagttgta

SEQ ID NO: 948 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
aatgaagaaagtacaaagaca

SEQ ID NO: 949 - RNA, 21 nt, synthetic construct
  modified_base 1: mod_base = gm
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gtccatgagaaacaagatgaa

SEQ ID NO: 950 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
caggagagcattccatcatta

SEQ ID NO: 951 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = OTHER; note = 2'-fluorocytidine
  modified_base 14: mod_base = OTHER; note = 2'-O-methyladenosine
  modified_base 15: mod_base = OTHER; note = 2'-fluorocytidine
  modified_base 16: mod_base = um
  modified_base 17: mod_base = OTHER; note = 2'-fluorocytidine
  modified_base 18: mod_base = um
  modified_base 19: mod_base = OTHER; note = 2'-fluoroadenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 952 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-fluoroadenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 953 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-fluoroadenosine
  source 1..21: mol_type = other RNA
cattttaatcctcactctaaa

SEQ ID NO: 954 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 955 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 956 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = ALNA
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 957 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 958 - RNA, 22 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cattttaatcctcactctaaat

SEQ ID NO: 959 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
actgtaatctgaagagttgta

SEQ ID NO: 960 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'C16 alkoxy uridine
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 961 - RNA, 22 nt, synthetic construct
  modified_base 1: mod_base = cm
  modified_base 1^2: mod_base = OTHER; note = phosphorothioate linkage
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cattttaatcctcactctaaat

SEQ ID NO: 962 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = OTHER; note = 2'C16 alkoxy uridine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 963 - RNA, 22 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2 -O-propargyluridine
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2 -deoxythymidine
  source 1..22: mol_type = other RNA
cattttaatcctcactctaaat

SEQ ID NO: 964 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
aaccattaaactgtaatctga

SEQ ID NO: 965 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 966 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 967 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
caggacctcattttaatccta

SEQ ID NO: 968 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 969 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = cm
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
actcatctgctaccctcaaaa

SEQ ID NO: 970 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 971 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = OTHER; note = 2'C16 alkoxy uridine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 972 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-fluoroadenosine
  modified_base 21: mod_base = OTHER; note = 2'-O-methyladenosine
  source 1..21: mol_type = other RNA
cattttaatcctcactctaaa

SEQ ID NO: 973 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
aaccattaaactgtaatctga

SEQ ID NO: 974 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
caggacctcattttaatccta

SEQ ID NO: 975 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
caggagagcattccatcatta

SEQ ID NO: 976 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = OTHER; note = 2'C16 alkoxy uridine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 977 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 978 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gaaagtaatggaccagtgaaa

SEQ ID NO: 979 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = gm
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
gcctgcatggattccatgtta

SEQ ID NO: 980 - RNA, 21 nt, synthetic construct
  modified_base 1: mod_base = OTHER; note = 2'-O-methyladenosine
  modified_base 2: mod_base = um
  modified_base 3: mod_base = um
  modified_base 4: mod_base = cm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
attccatgttcatgagtttga

SEQ ID NO: 981 - RNA, 21 nt, synthetic construct
  modified_base 1: mod_base = um
  modified_base 2: mod_base = gm
  modified_base 3: mod_base = cm
  modified_base 4: mod_base = OTHER; note = 2'-O-methyladenosine
  modified_base 5: mod_base = gm
  modified_base 6: mod_base = gm
  modified_base 7: mod_base = um
  modified_base 8: mod_base = cm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = um
  modified_base 15: mod_base = um
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
tgcaggtcctcactttaatca

SEQ ID NO: 982 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 983 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = OTHER; note = 2'-O-methyladenosine
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
aggatgaagagaggcatgtta

SEQ ID NO: 984 - RNA, 21 nt, synthetic construct
  modified_base 1: mod_base = cm
  modified_base 2: mod_base = um
  modified_base 3: mod_base = OTHER; note = 2'-O-methyladenosine
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = gm
  modified_base 18: mod_base = OTHER; note = 2'-O-methyladenosine
  modified_base 19: mod_base = um
  modified_base 20: mod_base = cm
  modified_base 21: mod_base = um
  source 1..21: mol_type = other RNA
ctattgaagattctgtgatct

SEQ ID NO: 985 - RNA, 21 nt, synthetic construct
  modified_base 1: mod_base = um
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = gm
  modified_base 21: mod_base = OTHER; note = 2'-O-methyladenosine
  source 1..21: mol_type = other RNA
ttggcttgtggtgtaattgga

SEQ ID NO: 986 - RNA, 21 nt, synthetic construct
  modified_base 1: mod_base = um
  modified_base 2: mod_base = OTHER; note = 2-aminoadenosine nucleotide
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = um
  modified_base 14: mod_base = gm
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
taaacattcccttggatgtaa

SEQ ID NO: 987 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = cm
  modified_base 6: mod_base = cm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
cattcccttggatgtagtcta

SEQ ID NO: 988 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 989 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gttatcctgctagctgtagaa

SEQ ID NO: 990 - RNA, 21 nt, synthetic construct
  modified_base 1: mod_base = gm
  modified_base 2: mod_base = cm
  modified_base 3: mod_base = um
  modified_base 4: mod_base = OTHER; note = 2'-O-methyladenosine
  modified_base 5: mod_base = gm
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctagctgtagaaatgtatca

SEQ ID NO: 991 - RNA, 21 nt, synthetic construct
  modified_base 1: mod_base = um
  modified_base 2: mod_base = OTHER; note = 2'-O-methyladenosine
  modified_base 3: mod_base = gm
  modified_base 4: mod_base = cm
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
tagctgtagaaatgtatccta

SEQ ID NO: 992 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = um
  source 1..21: mol_type = other RNA
gaaatgtatcctgataaacat

SEQ ID NO: 993 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
tcctgataaacattaaacact

SEQ ID NO: 994 - RNA, 21 nt, synthetic construct
  modified_base 1: mod_base = OTHER; note = 2-aminoadenosine nucleotide
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = um
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = um
  source 1..21: mol_type = other RNA
aaacattaaacactgtaatct

SEQ ID NO: 995 - RNA, 21 nt, synthetic construct
  modified_base 1: mod_base = um
  modified_base 2: mod_base = gm
  modified_base 3: mod_base = cm
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
tgctttaaagtacctgtagta

SEQ ID NO: 996 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
aaactgatttatgatcactta

SEQ ID NO: 997 - RNA, 21 nt, synthetic construct
  modified_base 1: mod_base = cm
  modified_base 2: mod_base = um
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = gm
  modified_base 19: mod_base = um
  modified_base 20: mod_base = um
  modified_base 21: mod_base = um
  source 1..21: mol_type = other RNA
cttggaagatttgtatagttt

SEQ ID NO: 998 - RNA, 21 nt, synthetic construct
  modified_base 1: mod_base = cm
  modified_base 2: mod_base = um
  modified_base 3: mod_base = gm
  modified_base 4: mod_base = um
  modified_base 5: mod_base = um
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = um
  source 1..21: mol_type = other RNA
ctgtttcaatgacctgtattt

SEQ ID NO: 999 - RNA, 21 nt, synthetic construct
  modified_base 1: mod_base = um
  modified_base 2: mod_base = um
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = gm
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
ttaaatcacagatgggtatta

SEQ ID NO: 1000 - RNA, 21 nt, synthetic construct
  modified_base 1: mod_base = OTHER; note = 2-aminoadenosine nucleotide
  modified_base 2: mod_base = gm
  modified_base 3: mod_base = OTHER; note = 2'-O-methyladenosine
  modified_base 4: mod_base = um
  modified_base 5: mod_base = gm
  modified_base 6: mod_base = gm
  modified_base 7: mod_base = gm
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine
  source 1..21: mol_type = other RNA
agatgggtattaaacttgtca

SEQ ID NO: 1001 - RNA, 21 nt, synthetic construct
  modified_base 1: mod_base = cm
  modified_base 2: mod_base = gm
  modified_base 3: mod_base = OTHER; note = 2'-O-methyladenosine
  modified_base 4: mod_base = gm
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
cgagcagaaggaaagtaatga

SEQ ID NO: 1002 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
cctgcatggattccatgttca

SEQ ID NO: 1003 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 1004 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 1005 - RNA, 21 nt, synthetic construct
  modified_base 1: mod_base = OTHER; note = 2'-O-methyladenosine
  modified_base 2: mod_base = um
  modified_base 3: mod_base = cm
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = um
  source 1..21: mol_type = other RNA
atcctgctagctgtagaaatt

SEQ ID NO: 1006 - RNA, 21 nt, synthetic construct
  modified_base 1: mod_base = um
  modified_base 2: mod_base = gm
  modified_base 3: mod_base = OTHER; note = 2-aminoadenosine nucleotide
  modified_base 4: mod_base = um
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = um
  modified_base 19: mod_base = gm
  modified_base 20: mod_base = um
  modified_base 21: mod_base = um
  source 1..21: mol_type = other RNA
tgatcacttggaagatttgtt

SEQ ID NO: 1007 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 1008 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1009 - RNA, 19 nt, synthetic construct
  modified_base 1: mod_base = um
  modified_base 2: mod_base = OTHER; note = 2-aminoadenosine nucleotide
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = OTHER; note = 2'-fluoroadenosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = um
  modified_base 13: mod_base = um
  modified_base 14: mod_base = OTHER; note = 2'-O-methyladenosine
  modified_base 15: mod_base = um
  modified_base 16: mod_base = cm
  modified_base 17: mod_base = cm
  modified_base 18: mod_base = um
  modified_base 19: mod_base = OTHER; note = 2'-O-methyladenosine
  source 1..19: mol_type = other RNA
taactcatctgttatccta

SEQ ID NO: 1010 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 1011 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1012 - RNA, 19 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = um
  modified_base 6: mod_base = um
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluoroadenosine
  modified_base 10: mod_base = um
  modified_base 11: mod_base = cm
  modified_base 12: mod_base = cm
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = OTHER; note = 2'-O-methyladenosine
  source 1..19: mol_type = other RNA
tcactttaatcctctatca

SEQ ID NO: 1013 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1014 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1015 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
gttaactcatctgttatccta

SEQ ID NO: 1016 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1017 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1018 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-fluoroadenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = OTHER; note = 2'-fluorouridine
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1019 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1020 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
gttaactcatctgttatccta

SEQ ID NO: 1021 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1022 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
gttaactcatctgttatccta

SEQ ID NO: 1023 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1024 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 1025 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1026 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1027 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gctcactttaatcctctatca

SEQ ID NO: 1028 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1029 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1030 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1031 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1032 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1033 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1034 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1035 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1036 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 1037 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-fluoroadenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-fluorouridine
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1038 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1039 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 1040 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1041 - RNA, 21 nt, synthetic construct
  modified_base 1: mod_base = gm
  modified_base 2: mod_base = um
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = cm
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gttatcctgctagctgtagaa

SEQ ID NO: 1042 - RNA, 21 nt, synthetic construct
  modified_base 1: mod_base = um
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
tcctgataaacattaaacact

SEQ ID NO: 1043 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 1044 - RNA, 21 nt, synthetic construct
  modified_base 1: mod_base = cm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = um
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
ccttaactcatctgttatcca

SEQ ID NO: 1045 - RNA, 21 nt, synthetic construct
  modified_base 1: mod_base = cm
  modified_base 2: mod_base = um
  modified_base 3: mod_base = cm
  modified_base 4: mod_base = OTHER; note = 2'-O-methyladenosine
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ctcatctgttatcctgctaga

SEQ ID NO: 1046 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = um
  modified_base 6: mod_base = OTHER; note = 2'-O-methyladenosine
  modified_base 7: mod_base = gm
  modified_base 8: mod_base = cm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
ctgctagctgtagaaatgtaa

SEQ ID NO: 1047 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
ccctgataaacattaaacaca

SEQ ID NO: 1048 - RNA, 21 nt, synthetic construct
  modified_base 1: mod_base = gm
  modified_base 2: mod_base = cm
  modified_base 3: mod_base = OTHER; note = 2-aminoadenosine nucleotide
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gcattaaacactgtaatctta

SEQ ID NO: 1049 - RNA, 21 nt, synthetic construct
  modified_base 1: mod_base = cm
  modified_base 2: mod_base = um
  modified_base 3: mod_base = OTHER; note = 2-aminoadenosine nucleotide
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
ctatgatcacttggaagatta

SEQ ID NO: 1050 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = cm
  modified_base 15: mod_base = cm
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gacctgtattttgccagacta

SEQ ID NO: 1051 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = cm
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = um
  modified_base 19: mod_base = cm
  modified_base 20: mod_base = OTHER; note = 2'-O-methyladenosine
  modified_base 21: mod_base = um
  source 1..21: mol_type = other RNA
ctgcatggattccatgttcat

SEQ ID NO: 1052 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
actggtggtccatgaaaaaga

SEQ ID NO: 1053 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
ccatgaaaaagcagatgactt

SEQ ID NO: 1054 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
aggtggaaatgaagaaagtaa

SEQ ID NO: 1055 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cccttaactcatctgttatca

SEQ ID NO: 1056 - RNA, 21 nt, synthetic construct
  modified_base 1: mod_base = cm
  modified_base 2: mod_base = um
  modified_base 3: mod_base = OTHER; note = 2-aminoadenosine nucleotide
  modified_base 4: mod_base = OTHER; note = 2'-O-methyladenosine
  modified_base 5: mod_base = cm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = gm
  modified_base 13: mod_base = um
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
ctaactcatctgttatcctga

SEQ ID NO: 1057 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = cm
  modified_base 5: mod_base = um
  modified_base 6: mod_base = gm
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = cm
  modified_base 16: mod_base = um
  modified_base 17: mod_base = OTHER; note = 2'-O-methyladenosine
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
catctgttatcctgctagtta

SEQ ID NO: 1058 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = cm
  modified_base 6: mod_base = um
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
cctgctagctgtagaaatgta

SEQ ID NO: 1059 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = um
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = cm
  modified_base 14: mod_base = um
  modified_base 15: mod_base = gm
  modified_base 16: mod_base = um
  modified_base 17: mod_base = um
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
cagttaaaatgtctgtttcaa

SEQ ID NO: 1060 - RNA, 21 nt, synthetic construct
  modified_base 1: mod_base = gm
  modified_base 2: mod_base = OTHER; note = 2-aminoadenosine nucleotide
  modified_base 3: mod_base = OTHER; note = 2'-O-methyladenosine
  modified_base 4: mod_base = um
  modified_base 5: mod_base = gm
  modified_base 6: mod_base = um
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
gaatgtctgtttcaatgactt

SEQ ID NO: 1061 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
cacagatgggtattaaactta

SEQ ID NO: 1062 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = um
  modified_base 20: mod_base = gm
  modified_base 21: mod_base = um
  source 1..21: mol_type = other RNA
gcagatgggtattaaacttgt

SEQ ID NO: 1063 - RNA, 21 nt, synthetic construct
  modified_base 1: mod_base = cm
  modified_base 2: mod_base = um
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = um
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
cttaactcatctgttatccta

SEQ ID NO: 1064 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1065 - RNA, 21 nt, synthetic construct
  modified_base 1: mod_base = cm
  modified_base 2: mod_base = OTHER; note = 2-aminoadenosine nucleotide
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
catgaaaaagcagatgacttt

SEQ ID NO: 1066 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
tcacagatgggtattaaactt

SEQ ID NO: 1067 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1068 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1069 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1070 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1071 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1072 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1073 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
cctcactttaatcctctatca

SEQ ID NO: 1074 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 1075 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 1076 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 1077 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 1078 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = um
  modified_base 5: mod_base = um
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cattttaatcctcactctaaa

SEQ ID NO: 1079 - RNA, 21 nt, synthetic construct
  modified_base 1: mod_base = gm
  modified_base 2: mod_base = um
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = um
  modified_base 15: mod_base = gm
  modified_base 16: mod_base = OTHER; note = 2'-O-methyladenosine
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
gttgaagattctgtgatctca

SEQ ID NO: 1080 - RNA, 21 nt, synthetic construct
  source 1..21: mol_type = other RNA
tttcactggtccattactttc

SEQ ID NO: 1081 - RNA, 21 nt, synthetic construct
  source 1..21: mol_type = other RNA
taacatggaatccatgcaggc

SEQ ID NO: 1082 - RNA, 21 nt, synthetic construct
  source 1..21: mol_type = other RNA
tcaaactcatgaacatggaat

SEQ ID NO: 1083 - RNA, 21 nt, synthetic construct
  source 1..21: mol_type = other RNA
tgattaaagtgaggacctgca

SEQ ID NO: 1084 - RNA, 21 nt, synthetic construct
  source 1..21: mol_type = other RNA
tgatagaggattaaagtgagg

SEQ ID NO: 1085 - RNA, 21 nt, synthetic construct
  source 1..21: mol_type = other RNA
taacatgcctctcttcatcct

SEQ ID NO: 1086 - RNA, 21 nt, synthetic construct
  source 1..21: mol_type = other RNA
agatcacagaatcttcaatag

SEQ ID NO: 1087 - RNA, 21 nt, synthetic construct
  source 1..21: mol_type = other RNA
tccaattacaccacaagccaa

SEQ ID NO: 1088 - RNA, 21 nt, synthetic construct
  source 1..21: mol_type = other RNA
ttacatccaagggaatgttta

SEQ ID NO: 1089 - RNA, 21 nt, synthetic construct
  source 1..21: mol_type = other RNA
tagactacatccaagggaatg

SEQ ID NO: 1090 - RNA, 21 nt, synthetic construct
  source 1..21: mol_type = other RNA
taggataacagatgagttaag

SEQ ID NO: 1091 - RNA, 21 nt, synthetic construct
  source 1..21: mol_type = other RNA
ttctacagctagcaggataac

SEQ ID NO: 1092 - RNA, 21 nt, synthetic construct
  source 1..21: mol_type = other RNA
tgatacatttctacagctagc

SEQ ID NO: 1093 - RNA, 21 nt, synthetic construct
  source 1..21: mol_type = other RNA
taggatacatttctacagcta

SEQ ID NO: 1094 - RNA, 21 nt, synthetic construct
  source 1..21: mol_type = other RNA
atgtttatcaggatacatttc

SEQ ID NO: 1095 - RNA, 21 nt, synthetic construct
  source 1..21: mol_type = other RNA
agtgtttaatgtttatcagga

SEQ ID NO: 1096 - RNA, 21 nt, synthetic construct
  source 1..21: mol_type = other RNA
agattacagtgtttaatgttt

SEQ ID NO: 1097 - RNA, 21 nt, synthetic construct
  source 1..21: mol_type = other RNA
tactacaggtactttaaagca

SEQ ID NO: 1098 - RNA, 21 nt, synthetic construct
  source 1..21: mol_type = other RNA
taagtgatcataaatcagttt

SEQ ID NO: 1099 - RNA, 21 nt, synthetic construct
  source 1..21: mol_type = other RNA
aaactatacaaatcttccaag

SEQ ID NO: 1100 - RNA, 21 nt, synthetic construct
  source 1..21: mol_type = other RNA
aaatacaggtcattgaaacag

SEQ ID NO: 1101 - RNA, 21 nt, synthetic construct
  source 1..21: mol_type = other RNA
taatacccatctgtgatttaa

SEQ ID NO: 1102 - RNA, 21 nt, synthetic construct
  source 1..21: mol_type = other RNA
tgacaagtttaatacccatct

SEQ ID NO: 1103 - RNA, 21 nt, synthetic construct
  source 1..21: mol_type = other RNA
tcattactttccttctgctcg

SEQ ID NO: 1104 - RNA, 21 nt, synthetic construct
  source 1..21: mol_type = other RNA
tgaacatggaatccatgcagg

SEQ ID NO: 1105 - RNA, 21 nt, synthetic construct
  source 1..21: mol_type = other RNA
tgagatcacagaatcttcaac

SEQ ID NO: 1106 - RNA, 21 nt, synthetic construct
  source 1..21: mol_type = other RNA
aaagtcatctgctttttcatg

SEQ ID NO: 1107 - RNA, 21 nt, synthetic construct
  source 1..21: mol_type = other RNA
aatttctacagctagcaggat

SEQ ID NO: 1108 - RNA, 21 nt, synthetic construct
  source 1..21: mol_type = other RNA
aacaaatcttccaagtgatca

SEQ ID NO: 1109 - RNA, 21 nt, synthetic construct
  source 1..21: mol_type = other RNA
aagtttaatacccatctgtga

SEQ ID NO: 1110 - RNA, 21 nt, synthetic construct
  source 1..21: mol_type = other RNA
tgatagaggattaaagtgagc

SEQ ID NO: 1111 - RNA, 19 nt, synthetic construct
  source 1..19: mol_type = other RNA
tgatagaggattaaagtga

SEQ ID NO: 1112 - RNA, 21 nt, synthetic construct
  source 1..21: mol_type = other RNA
taggataacagatgagttagg

SEQ ID NO: 1113 - RNA, 19 nt, synthetic construct
  source 1..19: mol_type = other RNA
taggataacagatgagtta

SEQ ID NO: 1114 - RNA, 21 nt, synthetic construct
  source 1..21: mol_type = other RNA
ttactttcttcatttccacct

SEQ ID NO: 1115 - RNA, 21 nt, synthetic construct
  source 1..21: mol_type = other RNA
taggataacagatgagttaac

SEQ ID NO: 1116 - RNA, 21 nt, synthetic construct
  source 1..21: mol_type = other RNA
tttagagtgaggattaaaatg

SEQ ID NO: 1117 - RNA, 21 nt, synthetic construct
  source 1..21: mol_type = other RNA
tgataggggattaaagtgagg

SEQ ID NO: 1118 - RNA, 21 nt, synthetic construct
  source 1..21: mol_type = other RNA
tggataacagatgagttaagg

SEQ ID NO: 1119 - RNA, 21 nt, synthetic construct
  source 1..21: mol_type = other RNA
tctagcaggataacagatgag

SEQ ID NO: 1120 - RNA, 21 nt, synthetic construct
  source 1..21: mol_type = other RNA
ttacatttctacagctagcag

SEQ ID NO: 1121 - RNA, 21 nt, synthetic construct
  source 1..21: mol_type = other RNA
tgtgtttaatgtttatcaggg

SEQ ID NO: 1122 - RNA, 21 nt, synthetic construct
  source 1..21: mol_type = other RNA
taagattacagtgtttaatgc

SEQ ID NO: 1123 - RNA, 21 nt, synthetic construct
  source 1..21: mol_type = other RNA
taatcttccaagtgatcatag

SEQ ID NO: 1124 - RNA, 21 nt, synthetic construct
  source 1..21: mol_type = other RNA
tagtctggcaaaatacaggtc

SEQ ID NO: 1125 - RNA, 21 nt, synthetic construct
  source 1..21: mol_type = other RNA
atgaacatggaatccatgcag

SEQ ID NO: 1126 - RNA, 21 nt, synthetic construct
  source 1..21: mol_type = other RNA
tctttttcatggaccaccagt

SEQ ID NO: 1127 - RNA, 21 nt, synthetic construct
  source 1..21: mol_type = other RNA
aagtcatctgctttttcatgg

SEQ ID NO: 1128 - RNA, 21 nt, synthetic construct
  source 1..21: mol_type = other RNA
tgataacagatgagttaaggg

SEQ ID NO: 1129 - RNA, 21 nt, synthetic construct
  source 1..21: mol_type = other RNA
tcaggataacagatgagttag

SEQ ID NO: 1130 - RNA, 21 nt, synthetic construct
  source 1..21: mol_type = other RNA
tagctagcaggataacagatg

SEQ ID NO: 1131 - RNA, 21 nt, synthetic construct
  source 1..21: mol_type = other RNA
tacatttctacagctagcagg

SEQ ID NO: 1132 - RNA, 21 nt, synthetic construct
  source 1..21: mol_type = other RNA
ttgaaacagacattttaactg

SEQ ID NO: 1133 - RNA, 21 nt, synthetic construct
  source 1..21: mol_type = other RNA
aggtcattgaaacagacattc

SEQ ID NO: 1134 - RNA, 21 nt, synthetic construct
  source 1..21: mol_type = other RNA
taagtttaatacccatctgtg

SEQ ID NO: 1135 - RNA, 21 nt, synthetic construct
  source 1..21: mol_type = other RNA
acaagtttaatacccatctgc

SEQ ID NO: 1136 - RNA, 21 nt, synthetic construct
  source 1..21: mol_type = other RNA
tcatgtttcttagagtgagga

SEQ ID NO: 1137 - RNA, 20 nt, synthetic construct
  source 1..20: mol_type = other RNA
tttagagtgaggattaaaat

SEQ ID NO: 1138 - RNA, 21 nt, synthetic construct
  source 1..21: mol_type = other RNA
ttttgagggtagcagatgagt

SEQ ID NO: 1139 - RNA, 21 nt, synthetic construct
  source 1..21: mol_type = other RNA
tacaactcttcagattacagt

SEQ ID NO: 1140 - RNA, 21 nt, synthetic construct
  source 1..21: mol_type = other RNA
tacagtttaatggtttgaggg

SEQ ID NO: 1141 - RNA, 21 nt, synthetic construct
  source 1..21: mol_type = other RNA
tcagattacagtttaatggtt

SEQ ID NO: 1142 - RNA, 21 nt, synthetic construct
  source 1..21: mol_type = other RNA
taggattaaaatgaggtcctg

SEQ ID NO: 1143 - RNA, 21 nt, synthetic construct
  source 1..21: mol_type = other RNA
tgtctttgtactttcttcatt

SEQ ID NO: 1144 - RNA, 23 nt, synthetic construct
  source 1..23: mol_type = other RNA
tttagagtgaggattaaaatgag

SEQ ID NO: 1145 - RNA, 21 nt, synthetic construct
  source 1..21: mol_type = other RNA
ttcatcttgtttctcatggac

SEQ ID NO: 1146 - RNA, 21 nt, synthetic construct
  source 1..21: mol_type = other RNA
taatgatggaatgctctcctg

SEQ ID NO: 1147 - RNA, 21 nt, synthetic construct
  source 1..21: mol_type = other RNA
gaaagtaatggaccagtgaaa

SEQ ID NO: 1148 - RNA, 21 nt, synthetic construct
  source 1..21: mol_type = other RNA
gcctgcatggattccatgtta

SEQ ID NO: 1149 - RNA, 21 nt, synthetic construct
  source 1..21: mol_type = other RNA
attccatgttcatgagtttga

SEQ ID NO: 1150 - RNA, 21 nt, synthetic construct
  source 1..21: mol_type = other RNA
tgcaggtcctcactttaatca

SEQ ID NO: 1151 - RNA, 21 nt, synthetic construct
  source 1..21: mol_type = other RNA
cctcactttaatcctctatca

SEQ ID NO: 1152 - RNA, 21 nt, synthetic construct
  source 1..21: mol_type = other RNA
aggatgaagagaggcatgtta

SEQ ID NO: 1153 - RNA, 21 nt, synthetic construct
  source 1..21: mol_type = other RNA
ctattgaagattctgtgatct

SEQ ID NO: 1154 - RNA, 21 nt, synthetic construct
  source 1..21: mol_type = other RNA
ttggcttgtggtgtaattgga

SEQ ID NO: 1155 - RNA, 21 nt, synthetic construct
  source 1..21: mol_type = other RNA
taaacattcccttggatgtaa

SEQ ID NO: 1156 - RNA, 21 nt, synthetic construct
  source 1..21: mol_type = other RNA
cattcccttggatgtagtcta

SEQ ID NO: 1157 - RNA, 21 nt, synthetic construct
  source 1..21: mol_type = other RNA
cttaactcatctgttatccta

SEQ ID NO: 1158 - RNA, 21 nt, synthetic construct
  source 1..21: mol_type = other RNA
gttatcctgctagctgtagaa

SEQ ID NO: 1159 - RNA, 21 nt, synthetic construct
  source 1..21: mol_type = other RNA
gctagctgtagaaatgtatca

SEQ ID NO: 1160 - RNA, 21 nt, synthetic construct
  source 1..21: mol_type = other RNA
tagctgtagaaatgtatccta

SEQ ID NO: 1161 - RNA, 21 nt, synthetic construct
  source 1..21: mol_type = other RNA
gaaatgtatcctgataaacat

SEQ ID NO: 1162 - RNA, 21 nt, synthetic construct
  source 1..21: mol_type = other RNA
tcctgataaacattaaacact

SEQ ID NO: 1163 - RNA, 21 nt, synthetic construct
  source 1..21: mol_type = other RNA
aaacattaaacactgtaatct

SEQ ID NO: 1164 - RNA, 21 nt, synthetic construct
  source 1..21: mol_type = other RNA
tgctttaaagtacctgtagta

SEQ ID NO: 1165 - RNA, 21 nt, synthetic construct
  source 1..21: mol_type = other RNA
aaactgatttatgatcactta

SEQ ID NO: 1166 - RNA, 21 nt, synthetic construct
  source 1..21: mol_type = other RNA
cttggaagatttgtatagttt

SEQ ID NO: 1167 - RNA, 21 nt, synthetic construct
  source 1..21: mol_type = other RNA
ctgtttcaatgacctgtattt

SEQ ID NO: 1168 - RNA, 21 nt, synthetic construct
  source 1..21: mol_type = other RNA
ttaaatcacagatgggtatta

SEQ ID NO: 1169 - RNA, 21 nt, synthetic construct
  source 1..21: mol_type = other RNA
agatgggtattaaacttgtca

SEQ ID NO: 1170 - RNA, 21 nt, synthetic construct
  source 1..21: mol_type = other RNA
cgagcagaaggaaagtaatga

SEQ ID NO: 1171 - RNA, 21 nt, synthetic construct
  source 1..21: mol_type = other RNA
cctgcatggattccatgttca

SEQ ID NO: 1172 - RNA, 21 nt, synthetic construct
  source 1..21: mol_type = other RNA
gttgaagattctgtgatctca

SEQ ID NO: 1173 - RNA, 21 nt, synthetic construct
  source 1..21: mol_type = other RNA
catgaaaaagcagatgacttt

SEQ ID NO: 1174 - RNA, 21 nt, synthetic construct
  source 1..21: mol_type = other RNA
atcctgctagctgtagaaatt

SEQ ID NO: 1175 - RNA, 21 nt, synthetic construct
  source 1..21: mol_type = other RNA
tgatcacttggaagatttgtt

SEQ ID NO: 1176 - RNA, 21 nt, synthetic construct
  source 1..21: mol_type = other RNA
tcacagatgggtattaaactt

SEQ ID NO: 1177 - RNA, 21 nt, synthetic construct
  source 1..21: mol_type = other RNA
gctcactttaatcctctatca

SEQ ID NO: 1178 - RNA, 19 nt, synthetic construct
  source 1..19: mol_type = other RNA
tcactttaatcctctatca

SEQ ID NO: 1179 - RNA, 21 nt, synthetic construct
  source 1..21: mol_type = other RNA
cctaactcatctgttatccta

SEQ ID NO: 1180 - RNA, 19 nt, synthetic construct
  source 1..19: mol_type = other RNA
taactcatctgttatccta

SEQ ID NO: 1181 - RNA, 21 nt, synthetic construct
  source 1..21: mol_type = other RNA
cctcactttaatcctctatta

SEQ ID NO: 1182 - RNA, 21 nt, synthetic construct
  source 1..21: mol_type = other RNA
gttaactcatctgttatccta

SEQ ID NO: 1183 - RNA, 21 nt, synthetic construct
  source 1..21: mol_type = other RNA
ccttaactcatctgttatcca

SEQ ID NO: 1184 - RNA, 21 nt, synthetic construct
  source 1..21: mol_type = other RNA
ctcatctgttatcctgctaga

SEQ ID NO: 1185 - RNA, 21 nt, synthetic construct
  source 1..21: mol_type = other RNA
ctgctagctgtagaaatgtaa

SEQ ID NO: 1186 - RNA, 21 nt, synthetic construct
  source 1..21: mol_type = other RNA
ccctgataaacattaaacaca

SEQ ID NO: 1187 - RNA, 21 nt, synthetic construct
  source 1..21: mol_type = other RNA
gcattaaacactgtaatctta

SEQ ID NO: 1188 - RNA, 21 nt, synthetic construct
  source 1..21: mol_type = other RNA
ctatgatcacttggaagatta

SEQ ID NO: 1189 - RNA, 21 nt, synthetic construct
  source 1..21: mol_type = other RNA
gacctgtattttgccagacta

SEQ ID NO: 1190 - RNA, 21 nt, synthetic construct
  source 1..21: mol_type = other RNA
ctgcatggattccatgttcat

SEQ ID NO: 1191 - RNA, 21 nt, synthetic construct
  source 1..21: mol_type = other RNA
actggtggtccatgaaaaaga

SEQ ID NO: 1192 - RNA, 21 nt, synthetic construct
  source 1..21: mol_type = other RNA
ccatgaaaaagcagatgactt

SEQ ID NO: 1193 - RNA, 21 nt, synthetic construct
  source 1..21: mol_type = other RNA
aggtggaaatgaagaaagtaa

SEQ ID NO: 1194 - RNA, 21 nt, synthetic construct
  source 1..21: mol_type = other RNA
cccttaactcatctgttatca

SEQ ID NO: 1195 - RNA, 21 nt, synthetic construct
  source 1..21: mol_type = other RNA
ctaactcatctgttatcctga

SEQ ID NO: 1196 - RNA, 21 nt, synthetic construct
  source 1..21: mol_type = other RNA
catctgttatcctgctagtta

SEQ ID NO: 1197 - RNA, 21 nt, synthetic construct
  source 1..21: mol_type = other RNA
cctgctagctgtagaaatgta

SEQ ID NO: 1198 - RNA, 21 nt, synthetic construct
  source 1..21: mol_type = other RNA
cagttaaaatgtctgtttcaa

SEQ ID NO: 1199 - RNA, 21 nt, synthetic construct
  source 1..21: mol_type = other RNA
gaatgtctgtttcaatgactt

SEQ ID NO: 1200 - RNA, 21 nt, synthetic construct
  source 1..21: mol_type = other RNA
cacagatgggtattaaactta

SEQ ID NO: 1201 - RNA, 21 nt, synthetic construct
  source 1..21: mol_type = other RNA
gcagatgggtattaaacttgt

SEQ ID NO: 1202 - RNA, 21 nt, synthetic construct
  source 1..21: mol_type = other RNA
cattttaatcctcactctaaa

SEQ ID NO: 1203 - RNA, 21 nt, synthetic construct
  source 1..21: mol_type = other RNA
gtccatgagaaacaagatgaa

SEQ ID NO: 1204 - RNA, 21 nt, synthetic construct
  source 1..21: mol_type = other RNA
tcctcactctaagaaacatga

SEQ ID NO: 1205 - RNA, 21 nt, synthetic construct
  source 1..21: mol_type = other RNA
actcatctgctaccctcaaaa

SEQ ID NO: 1206 - RNA, 21 nt, synthetic construct
  source 1..21: mol_type = other RNA
ccctcaaaccattaaactgta

SEQ ID NO: 1207 - RNA, 21 nt, synthetic construct
  source 1..21: mol_type = other RNA
aatgaagaaagtacaaagaca

SEQ ID NO: 1208 - RNA, 21 nt, synthetic construct
  source 1..21: mol_type = other RNA
actgtaatctgaagagttgta

SEQ ID NO: 1209 - RNA, 21 nt, synthetic construct
  source 1..21: mol_type = other RNA
caggagagcattccatcatta

SEQ ID NO: 1210 - RNA, 21 nt, synthetic construct
  source 1..21: mol_type = other RNA
aaccattaaactgtaatctga

SEQ ID NO: 1211 - RNA, 21 nt, synthetic construct
  source 1..21: mol_type = other RNA
caggacctcattttaatccta

SEQ ID NO: 1212 - RNA, 22 nt, synthetic construct
  source 1..22: mol_type = other RNA
cctcactttaatcctctatcat

SEQ ID NO: 1213 - RNA, 22 nt, synthetic construct
  source 1..22: mol_type = other RNA
cattttaatcctcactctaaat

SEQ ID NO: 1214 - RNA, 21 nt, synthetic construct
  source 1..21: mol_type = other RNA
  modified_base 20: mod_base = OTHER; note = 2-aminoadenine
taggataacagatgagttang

SEQ ID NO: 1215 - RNA, 21 nt, synthetic construct
  source 1..21: mol_type = other RNA
  modified_base 19: mod_base = OTHER; note = 2-aminoadenine
taggataacagatgagttnag

SEQ ID NO: 1216 - RNA, 21 nt, synthetic construct
  source 1..21: mol_type = other RNA
  modified_base 20: mod_base = OTHER; note = 2-aminoadenine
taggataacagatgagttnag

SEQ ID NO: 1217 - RNA, 21 nt, synthetic construct
  source 1..21: mol_type = other RNA
  modified_base 2: mod_base = OTHER; note = 2-aminoadenine
tnaacattcccttggatgtaa

SEQ ID NO: 1218 - RNA, 21 nt, synthetic construct
  source 1..21: mol_type = other RNA
  modified_base 2: mod_base = OTHER; note = 2-aminoadenine
cntgaaaaagcagatgacttt

SEQ ID NO: 1219 - RNA, 21 nt, synthetic construct
  source 1..21: mol_type = other RNA
  modified_base 3: mod_base = OTHER; note = 2-aminoadenine
tgntcacttggaagatttgtt

SEQ ID NO: 1220 - RNA, 19 nt, synthetic construct
  source 1..19: mol_type = other RNA
  modified_base 2: mod_base = OTHER; note = 2-aminoadenine
tnactcatctgttatccta

SEQ ID NO: 1221 - RNA, 21 nt, synthetic construct
  source 1..21: mol_type = other RNA
  modified_base 3: mod_base = OTHER; note = 2-aminoadenine
gcnttaaacactgtaatctta

SEQ ID NO: 1222 - RNA, 21 nt, synthetic construct
  source 1..21: mol_type = other RNA
  modified_base 3: mod_base = OTHER; note = 2-aminoadenine
ctntgatcacttggaagatta

SEQ ID NO: 1223 - RNA, 21 nt, synthetic construct
  source 1..21: mol_type = other RNA
  modified_base 3: mod_base = OTHER; note = 2-aminoadenine
ctnactcatctgttatcctga

SEQ ID NO: 1224 - RNA, 21 nt, synthetic construct
  source 1..21: mol_type = other RNA
  modified_base 2: mod_base = OTHER; note = 2-aminoadenine
gnatgtctgtttcaatgactt

SEQ ID NO: 1225 - RNA, 21 nt, synthetic construct
  source 1..21: mol_type = other RNA
  modified_base 19: mod_base = OTHER; note = 2-aminoadenine
cattttaatcctcactctnaa

SEQ ID NO: 1226 - RNA, 21 nt, synthetic construct
  source 1..21: mol_type = other RNA
  modified_base 21: mod_base = OTHER; note = 2-aminoadenine
cattttaatcctcactctaan

SEQ ID NO: 1227 - RNA, 21 nt, synthetic construct
  source 1..21: mol_type = other RNA
  modified_base 20: mod_base = OTHER; note = 2-aminoadenine
cattttaatcctcactctana

SEQ ID NO: 1228 - RNA, 19 nt, synthetic construct
  source 1..19: mol_type = other RNA
  modified_base 19: mod_base = OTHER; note = 2-aminoadenine
taggataacagatgagttn

SEQ ID NO: 1229 - RNA, 21 nt, synthetic construct
  source 1..21: mol_type = other RNA
  modified_base 1: mod_base = OTHER; note = 2-aminoadenine
naacattaaacactgtaatct

The invention claimed is:

1. An RNAi agent for inhibiting expression of a Superoxide Dismutase 1 (SOD1) gene, comprising:

an antisense strand comprising the nucleotide sequence cPrpusGfsaGfaucacagAfaUfcUfucasasc (SEQ ID NO: 646); and a sense strand comprising the nucleotide sequence guugaagaUfuCfuGfugaucuca (SEQ ID NO: 771)

wherein a, c, g, and u represent 2'-O-methyl adenosine, 2'-O-methyl cytidine, 2'-O-methyl guanosine, and 2'-O-methyl uridine, respectively; Af, Cf, Gf, and Uf represent 2'-fluoro adenosine, 2'-fluoro cytidine, 2'-fluoro guanosine, and 2'-fluoro uridine, respectively; cPrpu represents a 5'-cyclopropyl phosphonate-2'-O-methyl uridine, and s represents a phosphorothioate linkage.

2. The RNAi agent of claim 1, wherein the sense strand is between 18 and 30 nucleotides in length, and the antisense strand is between 21 and 30 nucleotides in length.

3. The RNAi agent of claim 1, wherein the sense strand and the antisense strand are each between 21 and 27 nucleotides in length.

4. The RNAi agent of claim 1, wherein the sense strand and the antisense strand are each between 21 and 24 nucleotides in length.

5. The RNAi agent of claim 1, wherein the sense strand and the antisense strand are each 21 nucleotides in length.

6. The RNAi agent of claim 1, wherein the RNAi agent has two blunt ends.

7. The RNAi agent of claim 1, wherein the sense strand comprises one or two terminal caps.

8. The RNAi agent of claim 1, wherein the sense strand comprises one or two inverted abasic residues.

9. The RNAi agent of claim 1, wherein the sense strand further includes one or more inverted abasic residues at the 3' terminal end of the nucleotide sequence, at the 5' end of the nucleotide sequence, or at both.

10. The RNAi agent of claim 1, wherein the RNAi agent is linked to a lipid moiety.

11. The RNAi agent of claim 10, wherein the lipid moiety is represented by the structure:

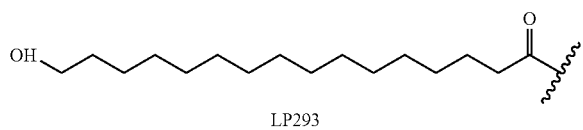 [SMILES: *C(=O)CCCCCCCCCCCCCCCO]

LP293 wherein ⌇ indicates the point of connection to the RNAi agent.

12. The RNAi agent of claim 11, wherein the lipid moiety is conjugated to the sense strand.

13. The RNAi agent of claim 12, wherein the lipid moiety is conjugated to the 5' terminal end of the sense strand.

14. The RNAi agent of claim 13, wherein the sense strand consists of the nucleotide sequence: LP293-(NH—C6)s (invAb)sguugaagaUfuCfuGfugaucucas(invAb) (SEQ ID NO: 1079), wherein LP293 has the structure:

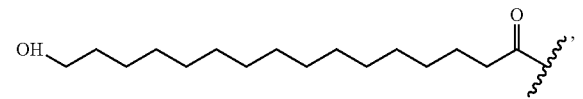 [SMILES: *C(=O)CCCCCCCCCCCCCCCO]

(NH—C6)s has the structure:

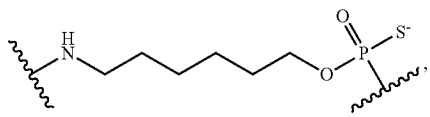

and (invAb)s has the structure:

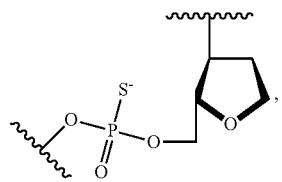

and (invAb) has the structure:

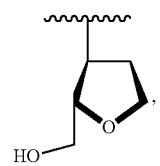

wherein ⌇ indicates the point of connection.

15. A pharmaceutical composition comprising the RNAi agent of claim 1, wherein the composition further comprises a pharmaceutically acceptable excipient.

16. The composition of claim 15, further comprising one or more additional therapeutics.

17. The composition of claim 15, wherein the RNAi agent is a mixed salt.

18. The composition of claim 15, wherein the pharmaceutically acceptable excipient comprises sodium chloride, calcium chloride, magnesium chloride, potassium chloride, sodium phosphate dibasic, sodium phosphate monobasic, or combinations thereof.

19. A method for inhibiting expression of a SOD1 gene in a cell, the method comprising introducing into a cell an effective amount of an RNAi agent of claim 1.

20. The method of claim 19, wherein the cell is within a subject.

21. The method of claim 20, wherein the subject is a human subject.

22. The method of claim 19, wherein following the administration of the RNAi agent the Superoxide Dismutase 1 (SOD1) gene expression is inhibited by at least about 30%.

23. A method of treating one or more symptoms or diseases associated with enhanced or elevated mutant SOD1 activity levels, the method comprising administering to a human subject in need thereof a therapeutically effective amount of the composition of claim 15.

24. The method of claim 23, wherein the disease is a neurodegenerative disease.

25. The method of claim 24, wherein the neurodegenerative disease is amyotrophic lateral sclerosis (ALS) or Alzheimer's Disease.

26. The method of claim 25, wherein the disease is ALS.

27. The method of claim 26, wherein the disease is SOD1-linked familial ALS.

28. The method of claim 23, wherein the RNAi agent is administered at a dose of about 0.01 mg/kg to about 5.0 mg/kg of body weight of the subject.

29. The method of claim 28, wherein the RNAi agent is administered at a dose of about 0.03 mg/kg to about 2.0 mg/kg of body weight of the subject.

30. The method of claim 23, wherein the RNAi agent is administered at a fixed dose of about 25 mg to about 450 mg.

* * * * *